US007375088B2

(12) United States Patent  
Bachmann et al.

(10) Patent No.: US 7,375,088 B2
(45) Date of Patent: May 20, 2008

(54) POLYENE POLYKETIDES, PROCESSES FOR THEIR PRODUCTION AND THEIR USE AS A PHARMACEUTICAL

(75) Inventors: Brian O. Bachmann, Nashville, TN (US); James B. McAlpine, Montréal (CA); Emmanuel Zazopoulos, Montréal (CA); Chris M. Farnet, Montréal (CA)

(73) Assignee: Thallion Pharmaceuticals Inc., Montreal (CA)

( * ) Notice: Subject to any disclaimer, the term of this patent is extended or adjusted under 35 U.S.C. 154(b) by 544 days.

(21) Appl. No.: 10/760,493

(22) Filed: Jan. 21, 2004

(65) Prior Publication Data

US 2005/0187167 A1    Aug. 25, 2005

Related U.S. Application Data

(60) Provisional application No. 60/494,568, filed on Aug. 13, 2003, provisional application No. 60/491,516, filed on Aug. 1, 2003, provisional application No. 60/469,810, filed on May 13, 2003, provisional application No. 60/441,123, filed on Jan. 21, 2003.

(51) Int. Cl.
*A01N 43/07* (2006.01)
*A61K 31/70* (2006.01)
*C07H 15/00* (2006.01)
*C07H 17/00* (2006.01)

(52) U.S. Cl. .......... 514/25; 536/4.1; 536/16.8; 536/16.9; 536/17.2; 536/17.9; 435/74; 435/886

(58) Field of Classification Search ............... 514/25; 536/4.1, 16.8, 16.9, 17.2, 17.9; 435/74, 886
See application file for complete search history.

(56) References Cited

U.S. PATENT DOCUMENTS

| 3,854,480 | A | 12/1974 | Zaffaroni |
| 3,890,199 | A * | 6/1975 | Miyamura et al. .......... 435/119 |
| 4,452,775 | A | 6/1984 | Kent |
| 4,946,778 | A | 8/1990 | Ladner et al. |
| 5,039,660 | A | 8/1991 | Leonard et al. |
| 6,361,974 | B1 | 3/2002 | Short et al. |
| 6,372,497 | B1 | 4/2002 | Stemmer |

FOREIGN PATENT DOCUMENTS

| CA | 2352451 | 7/2001 |
| WO | WO 01/34816 | 5/2001 |
| WO | WO 03/062458 | 7/2003 |

OTHER PUBLICATIONS

Pawlack et al., Journal of Antibiotics, (1980) vol. 33 No. 9, pp. 989-997 "The structure of lienomycin, a pentaene macrolide antitumor antibiotic".
Berge SM et al., Journal of Pharmaceutical Sciences, (1977) vol. 66 No. 1, pp. 1-19 "Pharmaceutical Salts".
Goodfellow, Bergey's manuel of systematic bacteriology, vol. 4, pp. 2322-2339 "Suprageneric classification of actinomycetes".
Embley et al., Annu. Rev. Microbiol., (1994) vol. 48, pp. 257-289 "The molecular phylogeny and systematics of the actinomycetes".
Shah, J. Antibiotics (Tokyo), (2000) vol. 53, No. 5, pp. 502-508 "Cloning, characterization and heterologous expression of a polyketide synthase and P-450 oxidase involved in the biosynthesis of the antibiotic oleandomycin".
Rangaswamy et al., Proc. Natl. Acad. Sci. USA, (1998) vol. 95, pp. 15469-15474 "Biosynthesis of the Pseudomonas polyketide coronafacic acid requires monofunctional and multifonctional polyketide synthase protiens".
Kakavas et al., J Bacteriol., (1997) vol. 179, No. 23, pp. 7515-7522 "Free in PMC Identification and characterization of the niddamycin polyketide synthase genes from *Streptomyces caelestis*."
Brautaset et al., Chem. Biol., (2000) vol. 7, No. 6, pp. 395-403 "Biosynthesis of the polyene antifungal antibiotic nystatin in *Streptomyces noursei* ATCC 11455: analysis of the gene cluster and deduction of the biosynthetic pathway".
Fisher et al., Structure Fold Des., (2000) vol. 8, No. 4, pp. 339-347 "The X-ray structure of *Brassica* napus beta-keto acyl carrier protein reductase and its implications for substrate bindingand catalysis".
Stryer, Biochemistry 3rd edition, (1998) W.H. Freeman and Co., New York, pp. 752-754.
Altschul et al., J. Mol. Biol., (1990) vol. 215, No. 3, pp. 403-410 "Basic local alignment search tool".
Hopwood, Chem. Rev., (1997) vol. 97, No. 7, pp. 2465-2497 "Genetic Contributions to Understanding Polyketide Synthases".
McDaniel et al., Proc. Natl. Acad. Sci. USA, (1999) vol. 96, pp. 18646-18651 Multiple genetic modifications of the erythromycin polyketide synthase to produce a library of novel "unatural" natural products.
Reid et al., Biochemistry, (2003) vol. 42, No. 1, pp. 72-79 "Abstract A model of structure and catalysis for ketoreductase domains in modular polyketide synthases".
Oppermann, Udo CT et al., Biochemistry, (1997) vol. 36(1), pp. 34-40 "Active site directed mutagenesis of 3/17-hydroxysteroid dehydrogenase establishes differential effects on short-chain dehydrogenase/reductase reactions".

(Continued)

*Primary Examiner*—Shaojia Anna Jiang
*Assistant Examiner*—Traviss McIntosh

(57) ABSTRACT

This invention relates to a new class of polyene polyketides, their pharmaceutically acceptable salts and derivatives, and to methods for obtaining the compounds. One method of obtaining these compounds is by cultivation of novel strains of *Streptomyces aizunensis*; another method involves expression of biosynthetic pathway genes in transformed host cells. The present invention further relates to the novel strains of *Streptomyces aizunensis* used to produce these compounds, to the use of these compounds and their pharmaceutically acceptable salts and derivatives as pharmaceuticals, in particular to their use as inhibitors of fungal cell growth and cancer cell growth. The invention also relates to pharmaceutical compositions comprising these novel polyketides or a pharmaceutically acceptable salts or derivatives thereof. Finally, the invention relates to novel polynucleotide sequences and their encoded proteins, which are involved in the biosynthesis of these novel polyketides.

24 Claims, 31 Drawing Sheets

OTHER PUBLICATIONS

Zoller et al., Methods in Enzymol, (1983) vol. 100, p. 468-500 "Oligonucleotide-directed mutagenesis of DNA fragments cloned into M13 vectors".

Dalbie-McFarland G et al., Proc. Natl. Acad. Sci. USA (1982) vol. 79, No. 21, pp. 6409-6413 "Oligonucleotide-directed mutagenesis as a general and powerful method for studies of protein function".

Oliynyk et al., Chem. Biol., (1996) vol. 3, No. 10, pp. 833-839 "A hybrid modular polyketide synthase obtained by domain swapping".

Hans et al., J. Am. Chem. Soc., (2003) vol. 125 No. 18, pp. 5366-5374 "Mechanistic analysis of acyl transferase domain exchange in polyketide synthase modules".

Kao et al., Science, (1994) vol. 265(5171), pp. 509-512 "Abstract Engineered biosynthesis of a complete macrolactone in a heterologous host".

Oh, SH; Chater KF, Journal of Bacteriology, (1997) vol. 179, No. 1, pp. 122-127 "Denaturation of circular or linear DNA facilitates targeted integrative transformation of Streptomyces coelicolor A3(2): possible relevance to other organisms".

Arrowsmith et al., Mol. Gen. Genet., (1992) vol. 234, No. 2, pp. 254-264 "Characterisation of actI-homologous DNA encoding polyketide synthase genes from the monensin producer Streptomyces cinnamonensis".

Paradkar et al., Appl. Environ. Microbiol., (2001) vol. 67, No. 5, pp. 2292-2297 "Applications of gene replacement technology to Streptomyces clavuligerus strain development for clavulanic acid production".

Blanco et al., Mol. Gen. Genet., (2000) vol. 262, No. 6, pp. 991-1000 "Characterization of two glycosyltransferases involved in early glycosylation steps during biosynthesis of the antitumor polyketide mithramycin by Streptomyces argillaceus".

Chen et al., Gene, (2001) vol. 263, No. 1-2, pp. 255-264 "The Strptomyces venezuelae pikA V gene contains a transcription unit essential for expression of enzymes involved in glycosylation of narbonolide and 10-deoxymethynolide".

Schaffner CP, Mavrolide Antibiotics: Chemistry, biology and practice, S. Omura, ed. Academic Press (1984) p. 491-492 "Polyene microlides in clinical practice".

Schaffner CP and Gordon HW, Proc. Natl. Acad. Sci. USA (1968) vol. 61, No. 1, p. 36 "The hypocholesterolemic activity of orally administered polyene macrolides".

Carrillo H et al., Siam J. Applied Math., (1988) vol. 48, No. 5, pp. 1073-1082 "The multiple sequence alignment problem in biology".

Gluzman Y, Cell, (1981) vol. 23, No. 1, pp. 175-182 "SV40-transformed simian cells support the replication of early SV40 mutants".

Leung DW et al., Technique, (1989) vol. 1, pp. 11-15 "A method for random mutagenesis of a defined DNA segment using a modified polymerase chain reaction".

Caldwell RC et al., PCR Methods Applic., (1992) vol. 2, pp. 28-33 "Randomization of genes by PCR mutagenesis".

Reidbarr-Olson, JF et al., Science, (1988) vol. 241 (4861), pp. 53-57 "Combinatorial cassette mutagenesis as a probe of the informational content of protein sequences".

Kholer et al., Nature, (1975) vol. 256, pp. 495-497 "Continuous cultures of fused cells secreting antibody of predefined specificity".

Kozbor et al., Immunology Today, (1983) vol. 4, No. 3, pp. 72-79 "The production of monoclonal antibodies from human lymphocytes".

Cole et al., Monoclonal Antibodies and Cancer Therapy, Alan R. Liss Inc., (1985) pp. 77-96 "The EBV-hybridoma technique and its application to human lung cancer".

Wood T., Methods in Enzymology, (1988) vol. 160, pp. 87-116 "Methods for measuring Cellulase Activities".

Katz, Chem. Rev., (1997) vol. 97, No. 7, pp. 2557-2575 "Manipulation of Modular Polyketide Synthases".

Zazopoulos et al., Nature Biotechnology, (2003) vol. 21, pp. 187-190 "A genomics-guided approach for discovering and expressing cryptic metabolic pathways".

Grote R., Zeeck A., J. Antibiot., (1988) vol. 41, pp. 1178-1195 "Colabomycin A from Streptomyces griseoflavus Tue 2880".

Osada et al., J. Antibiot., (1991) vol. 44, pp. 1463-1466 "Enopeptin-A from Streptomyces griseus".

He H et al., J. Antibiot., (2000) vol. 53, No. 2, pp. 191-195 "Isolation and structural elucidation of AC326-alpha, a new member of the moenomycin group".

Wong GK et al., J Antiobiotics, (1998) vol. 51, No. 5, pp. 487-491 "Antifungal activitites of rapamycin and its derivatives, prolyrapamycin, 32-desmethylrapamycin, and 32-desmethoxyrapamycin".

Arikan S et al., Antimicrobial Agents and Chemotherapy, (2003) vol. 47, No. 8, pp. 2640-2643 "Comparison of two methods and three end points in determination of in vitro activity of micafungin againts Aspergillus spp."

Dubois N et al., Microbiology, (1998) vol. 144, pp. 2299-2310 "Antifungal activities of rapamycin and its derivatives, prolyrapamycin, 32-desmethylrapamycin, and 32-desmethoxyrapamycin".

Fisher H. et al., Proceedings of the Society for Experimental Biology and Medecine, (1974) vol. 145, pp. 836-839 "Effect of candicidin on plasma cholesterol and avian atherosclerosis."

Pagliano FM, Arch Sci Med (Torino), (1979) vol. 136, pp. 303-308 "Correction of hyperdyslipidemia using polyene-structure substances. Controlled clinical trial".

Barbaro A. et al., Archivio per Scienze Mediche, (1980) vol. 137, pp. 211-216 "Action of a polyene macrolide on hyperdislipidaemic disorders".

Singhal AK et al, Lipids, (1981) vol. 16, p. 423-426 "C.P. Effect of candicidin on cholesterol and bile acid metabolism in the rat".

Staprans I et al., Arteriosclerosis, Thrombosis and Vascular Biology, (1998) vol. 18, pp. 977-983 "Oxidized cholesterol in the diet accelerates the development of aortic atherosclerosis in cholesterol-fed rabbits".

Thiery J et al., Arteriosclerosis, Thrombosis and Vascular Biology, (1995) vol. 15, pp. 1181-1188 "Low atherosclerotic response of a strain of rabbits to diet-induced hypercholesterolemia".

Chen S. et al, Chemistry & Biology, (2003) vol. 10, pp. 1065-1076 "Organizational and mutational analysis of a complete FR-008/Candicidin gene cluster encoding a stucturally relatedpolyene complex".

Micklewright P.F., Trigger D.J., J. Pharm. Pharmac., (1974) vol. 26 suppl., pp. 108P-109P "The effect of candicidin on exogenous cholesterol absorption in small laboratory animals".

Worthen, D.R. et al., Drug Development and Industrial Pharmacy, (2001) vol. 27, No. 4, pp. 277-286 "Methods for the recovery and purification of polyene antifungals".

Staunton, J., Weissman, K.J., Nat. Prod. Rep., (2001) vol. 18, pp. 380-416 "Polyene biosynthesis: a millennium review".

Sakuda et al., Tetrahedron Letters, (1995) vol. 36, No. 16, pp. 2777-2780 "Linearmycin A, a novel linear polyene antibiotic".

Sakuda et al., J Chem. Soc. Perk. Trans., (1996) 1, pp. 2315-2319 "Novel linear polyene antibiotics: linearmycins".

* cited by examiner

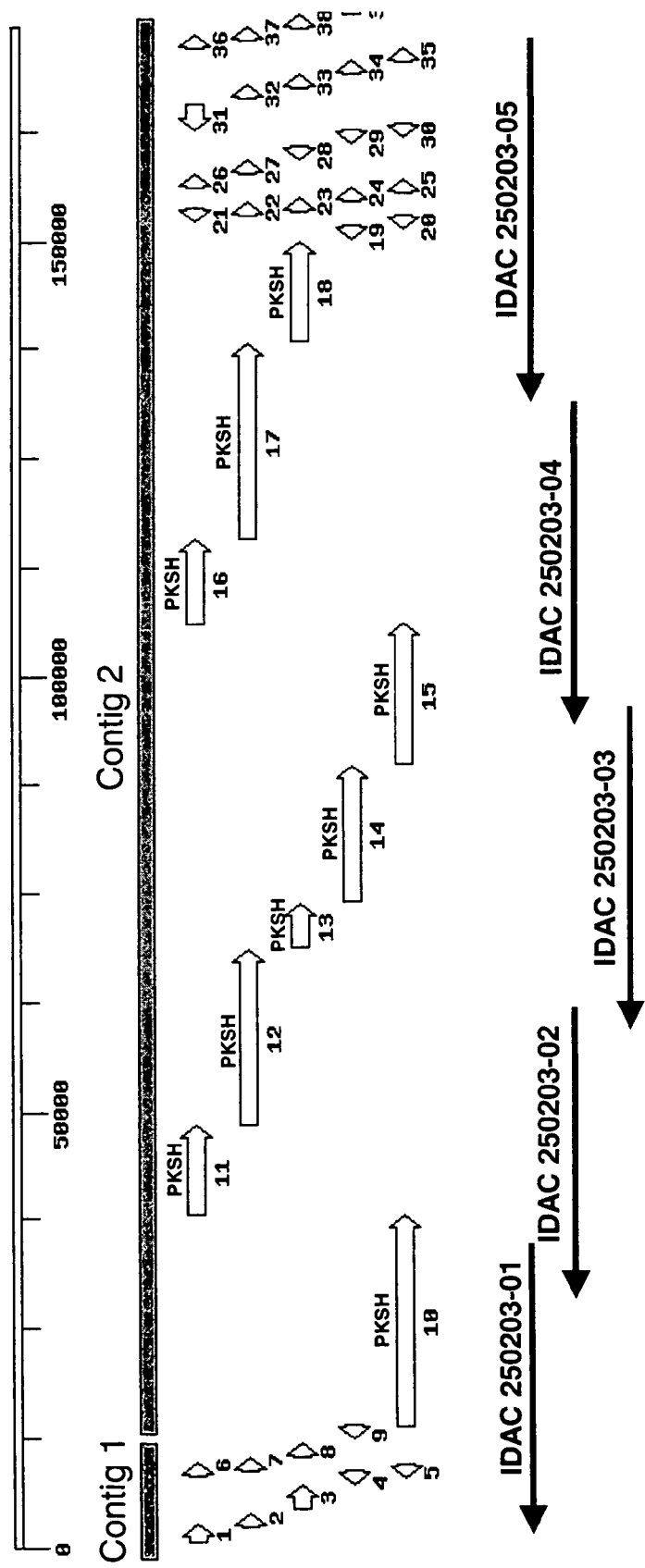

Figure 2a

```
ORF10_pKS01    PIAIVGIGCHFPGGVQSPEALWNLVETGTDAISAFPTGRGWDLDALYDPDPDRAGTSYAR
ORF10_pKS02    PIVIVSMSCRFPGGVRTPEDLWQLLADGTDTVAAFPADRGWDLDGLYSADPERSGTSYTR
ORF10_pKS03    PIAIVSMSCRFPGGVRTPEDLWRLLVDGTDAVGAFPADRGWDLDRLYSPDPDQPGTSYTR
ORF10_pKS04    PIVIVGMGCRFPGGVRSPEDLWQLVATGGDGITGFPSDRGWNVEALYHPDPDHAGTSYTR
ORF10_pKS05    PIAIVAMSCRFPGGVRTPEDLWRLLSTGGDAIGEFPADRGWDLSRLYSPDPDKQGTFYAR
ORF11_pKS01    PIAIVAMSCRFPNGVGSPEDLWRLVDEGGDAITGFPADRGWDIESLADPDPDRKGTFYNT
ORF11_pKS02    PIAIVAMSCRYPGGVRTPEELWRLVETGGDAIAGLPGNRGWDTDALH---ADEDGRTFA-
ORF12_pKS01    PIAIVGMSCRFPGGVSSPEDLWRLVESGGDAISGFPVNRGWDIESLYDPDPDHEGTTYAR
ORF12_pKS02    PIAIVAMSCRFPGGIASPEDLWQLLVTGRDGITGFPADRGWDLDSLYSDDPDREGTSYAR
ORF12_pKS03    PIAIVSMSCRFPGGVRTPEDLWELLSTGGDAISDLPLDRGWDIDALYDADPSTQGTSYAR
ORF12_pKS04    PIAIVAMSCRFPGGVRTPEDLWQLLATGRDAIGEFPEDRGWDAEALFGP-QFEQDAPYAR
ORF13_pKS01    PIAITAMSCRFPGGVRSPEELWELLRTGGDALTAFPADRGWDLDNLFSDDPDDHNTSVTR
ORF14_pKS01    PIAIVGMGCRYPGGVTSPEELWQLVVDGGDAISGFPADRGWDMETVYHPDPEHPGTSYAN
ORF14_pKS02    PIAIVAMSCRFPGGVQSPEDLWQLLSTGRDAISGFPGDRGWDLDGLYDPESAGENTSYVR
ORF14_pKS03    PIAIVAMSCRYPGDVRTPEDLWQLLTAGADGITRLPENRGWDTEGLYDPDPESQGTSYAR
ORF15_pKS01    PIAVVAMSCRYPGGIDTPEKLWDLVAHGRDAVSAYPTDRGWDAEVLFDPDPETGIEAYEQ
ORF15_pKS02    PIAIVAMSCRYPGGVTTPEELWQLLAGGGDAISGFPADRGWDVESLYDPDPDHPGTSYTR
ORF15_pKS03    PIAIVGLGCRYPGGVESPDDLWRLVLEGRDAITEFPEDRGWDVDALFDADPDQQGTSYAR
ORF16_pKS01    PIAIVAMSCRYPGGVRSPEDLWRLVENGDDAVSGFPVDRGWDVEALYDADPDSSGSSYVS
ORF16_pKS02    PIAIVAMSCRFPGGVRNPEELWQLLTSEGDGLSQFPLDRGWDVDALYDPNPDAQGTSYTR
ORF17_pKS01    PIAIVGMSCRFPGGIESPEGLWDLVAGGRDAITDFPTDRGWDIESLYDADPDQQGTSYTR
ORF17_pKS02    PIAIVGMSCRYPGGVTTPEELWQLVAGSVDAISPFPTDRGWNLDALYDADPGRAGTSYTR
ORF17_pKS03    PIAIVAMSCRFPGDVRTPEDLWELLAEGRDGISDLPDDRGWDTEALYDPDPDSPGTSYAR
ORF17_pKS04    PIAIVGMSCRYPGGVETPEDLWRLVVGGGDAISEFPQGRGWDLESLYDPDPDGKGTSYTR
ORF18_pKS01    PIAIVGMSCRYPGDVESPEDLWRLVSEETDAISPFPTDRGWDMGRLFDADPDGRGTSYVQ
ORF18_pKS02    PIAIVAMSCRFPGGVRSPEDLWGLVLDGRDAISDMPDDRGWDVEGLFDPDPDRPGTSYSR
               **.:...:.*::*...:  .*: ** *:     *  :    * .***:    :

ORF10_pKS01    EGGFLHDADAFDAAFFGISPREALAMDPQQRLLLEASWEAFDRAGVDPAALRGGQVGVFV
ORF10_pKS02    EGGFLYDAADFDADFFGISPREALAMDPQQRLLLETAWETFERAGIDPASLRGSQAGVFV
ORF10_pKS03    EGGFFDGAADFDPGFFGISPREALAMDPQQRLLLETSWEAIERAGIDPSSLRGSQAGVFV
ORF10_pKS04    EGGFLHDAADFDPGFFGISPREALAMDPQQRLLLETSWEAFERAGIDPATLRGSRTGVFA
ORF10_pKS05    AGGFLYDAADFDADFFGISPREALAMDPQQRLLLETSWEAFERAGIDPSSLRGSQAGVFV
ORF11_pKS01    GGGFLDGATAFDPGFFGISPREALAMDPQQRQLLETSWEVFERAGIDPAAVRGSRTGVYV
ORF11_pKS02    -GGFLYDADSFDADFFGISPREALAMDPQQRLLLETSWEAIERAGIDPSSLRGSRAGVFV
ORF12_pKS01    DGGFLHEAADFDPAFFGISPREALAMDPQQRLLLETTWEVFERAGIDPASLRGSRAGVFV
ORF12_pKS02    EGGFLHEAAEFDASFFGISPREALAMDPQQRLLLETTWETFERAGIDPTSLRGSRTGVFV
ORF12_pKS03    AGGFLYDAADFDADFFGISPREALAMDPQQRLLLETSWEAFERAGIDPETLRGSQAGVFV
ORF12_pKS04    EGGFLYDVADFDPAFFGISPREALAMDPQQRLLLETSWEAFERAGIDPLSVRGSQAGVFV
ORF13_pKS01    EGGFLGEASSFDAAFFGISPREAMAMDPQQRLLLETSWEAFERAGIDPQALRGSQSGVFV
ORF14_pKS01    QGGFVRDFARFDPSLFGISPREALAMDPQQRLLLETSWEAFERAGIDPTSMRGKQVGVFV
ORF14_pKS02    EGGFLAGATEFDPAFFGISPREALAMDPQQRLLLETSWEAFERAGIDPATVRGEQIGVFT
ORF14_pKS03    DGGFLHDAAEFDASFFGISPREALAMDPQQRLLLETTWEVFERAGIAPSAVRGSRTGVFA
ORF15_pKS01    VGGFLHDAADFDPAFFGISPREALAMDPQQRLLLETSWEAFERAGIDPATLRGSRTGVFA
ORF15_pKS02    HGGFLRDAAAFDPTFFGISPREAVGTDPQQRLLLETTWEAFERAGIDPATVRGSRTGVFA
ORF15_pKS03    EGGFVRDAGHFDPAFFGISPREAVAMDPQQRLLLETSWEAFERAGIDPAALRGSRTGVFA
ORF16_pKS01    EGGFLYDAASFDPAPFGISPREALAMDPQQRLLLEASWEAFERAGIDPSSVRGSRTAVFA
ORF16_pKS02    EGGFLSDAAAFDSSFFGISPREALAMDPQQRLLLETSWEAFERAGIDPQTLRGSQSGVFV
ORF17_pKS01    EGGFLDGVGKFDASFFGISPRETLGMDPQQRLLLETSWEAFERAGIDAATLRGSKAGVFI
ORF17_pKS02    EGGFLHDAADFDPDVFGINPREALAMDPHQRLLLETSWEAFEQAGIAPSSMRGSRTGVFA
ORF17_pKS03    EGGFFYDAHHFDPAFFGINPREALAMDPQQRLLLETSWEAFERAGIDPTGLRGKQVGVFV
ORF17_pKS04    SGGFLHDAGRFDPAFFGISPREAVAMDPQQRLLLETSWEAFERAGIDPASMRGSRTGVFA
ORF18_pKS01    EGGFLHSANRFDPAFFGISPREAVAMDPQQRLLLETSWEAFERAGIDPTSLRGSRTGVFA
ORF18_pKS02    AGGFLHDAHHFDPTFFGISPREALATDPQQRLLLETSWEAFERAGIDPATVRGSRTGVFA
               ***.     **. ***.***::. **:** ***::**.:::**:  . :** : .*:
```

Figure 2b

```
ORF10_pKS01    GAETQEYGPRLQ------DATDGFEGYLVTGNAASVASGRIAYTFGFEGPTVTVDTACSS
ORF10_pKS02    GTNGQDYLSLVTREGDG---LDGLEGHVGTGNAASVVSGRLSYVFGLEGPAITVDTACSS
ORF10_pKS03    GTNGQDYLSLITRESE------GLEGHLGTGNAGSVMSGRVSYVLGLEGPAVTVDTACSS
ORF10_pKS04    GVMYHDYVTGIGDGGSAVELPEGVEGYLGTGNAGSIASGRIAYTFGLEGPAVTVDTACSS
ORF10_pKS05    GTNGQDYGAMLQTIPD------GIEGFLGTGNAASVVSGRLSYAFGLEGPAVTVDTACSA
ORF11_pKS01    GAGAMGYGADLKEA------PEGLEGLLLTGGATSVLSGRVSYVFGLEGPAATVDTACSS
ORF11_pKS02    GAAYSGYDAQLEQSG-----VDGVLGHVMTGNAGSVMSGRVSYALGLEGPAVTVDTACSS
ORF12_pKS01    GASANAYGAGSHDL------PDGVEGHLLTGTASSVLSGRLAYVFGLEGPAATIDTACSS
ORF12_pKS02    GSNAQDYLQLWLNDAD------GLEGHLGTGNAASVVSGRLSYTFGLEGPAVTVDTACSS
ORF12_pKS03    GTNGQDYLSVLLEEPE------GLEGHLGTGNAASVVSGRLSYVFGLEGPAVTVDTACSS
ORF12_pKS04    GTNGQDYLSLVLNSAD------GGDGFMSTGNSASVVSGRLSYVFGLEGPAVTVDTACSA
ORF13_pKS01    GINGSDYLTPLLEAAE------DYAGHLGTGNASSVMSGRLSYTFGLEGPAVTVDTACSA
ORF14_pKS01    GTSNHDYLSALLSS------SENVEGYLGTGNAASVASGRLSYTFGLEGPAVTVDTACSS
ORF14_pKS02    GTNGQDYLNVILAAPD------GVEGFLGTGNAASVVSGRVSYVLGLEGPAVTVDTACSS
ORF14_pKS03    GVMYHDYGARLH------AVPDGVEGYLGTGSSSSIVSGRVAYTFGLEGPAVTVDTACSS
ORF15_pKS01    GLMYHDYAARLF------SVPEEIEGPLGNGSSGSIASGRIAYTLGLEGPAVTVDTACSS
ORF15_pKS02    GVMYHDYAALLE------RSKDGADGSLGSGSTGSIASGRVSYTFGLEGPAVTIDTACSS
ORF15_pKS03    GVMYHDYASRLT------ALPEGVEGFLGTGNAASVISGRLSYAFGLEGPAITVDTACSS
ORF16_pKS01    GVMYHDYTARLD------SVPEGVEGFLGTGSSGSIASGRVAYTFGLEGPAVTVDTACSS
ORF16_pKS02    GTNGSDYSNLVRAGAD------GLEGHLATGNAGSVVSGRLSYTFGLEGPAVTVDTACSA
ORF17_pKS01    GTNGQDYPELLREVPK------GVEGYLLTGNAASVVSGRISYTFGLEGPAVTVDTACSA
ORF17_pKS02    GVMYHDYLTRLP------AVPEGLEGYLGTGTAGSVASGRISYTFGLEGPAVTVDTACSS
ORF17_pKS03    GQMHNDYVSRLN------TVPEGVEGYLGTGGSSIASGRVSYTFDFEGPAVTVDTACSS
ORF17_pKS04    GIMYHDYATRIT------SVPDGVEGYLGTGNSGSIASGRVSYAFGLEGPAVTVDTACSS
ORF18_pKS01    GVMYHDYASRLR------AVPEEVEGYLGTGGSSSIASGRVSYTFGLEGPALTVDTACSS
ORF18_pKS02    GVMYNDYGTLLH------RAPEGLEGYMGTSSSGSVASGRVSYTFGLEGPAVTVDTACSS
               *      *                *  :   *:  ***::*.:..:***: *:***:*:

ORF10_pKS01    SLAALHLAVQALRTGECSLALAGGVAVMASPGSFVSFSRQRGLAPDGRCKPFAAAADGTA
ORF10_pKS02    SLVALHLAVQALRQGECTLALAGGVTVMSTPDAFVDFSRQRGLAEDGRIKAFASAADGTG
ORF10_pKS03    SLVALHWAIQALRQGECSMALAGGVTVMSTPENFVDFSRQRGLAEDGRIKAFASAADGTG
ORF10_pKS04    SLVALHWAIQALRSGECTMALAGGVAVMATPETFVDFSRQRGLSADGRCKSFAAAADGTG
ORF10_pKS05    SLVALHWAVQALRSGECSLALAGGVTVMSSPGAYIDFSRQRGLAEDGRIKAFAAAADGTG
ORF11_pKS01    SLVALHLATQALRQRECSLALVGGVCVMPSPDVFVEFSRQRGLSPDGRCKSFAASADGTG
ORF11_pKS02    SLVALHWAIQALRNGECSLALAGGVTVMSTPGTFSEFSQQGGLSPDGRCKAFASAADGTG
ORF12_pKS01    SSVALHMAVQALRQGECSLALAAGVTVLAGPDVFVEFSRQRGLSPDGRCRSFAESADGTG
ORF12_pKS02    SLVTLHLAAQALRRGECSMALAGAVTIMSTPGAFTEFSRQRGLAADGRIKAFAAAADGTS
ORF12_pKS03    SLVALHWAIQALRNGECSLALAGGVTVMSTPGTFIEFSRQRGLAEDGRIKAFAAAADGTG
ORF12_pKS04    SLVALHLAVQALRNGECSLALAGGVTVMSTPGAFAEFSRQRGLAEDGRIKAFAAAADGTG
ORF13_pKS01    SLVALHLAVQALRAGECSLAVAGGVHVMSTPGLFVEFSKQRGLSTDGRCKAFAAGADGTG
ORF14_pKS01    SSVALHLAVQALRNGECSLALAGGATLMSAPGTFIDYSKQRGLATDGRCKAFSPDADGFS
ORF14_pKS02    SLVALHWAIQALRQGECTMALAGGVTVMSTPASFIDFSRQRGLAEDGRIKAFAAAADGTG
ORF14_pKS03    SLVALHLAAQALRNGECSLALAGGVTVMFTPGTFIEFSRQRGLAADGRCKSFAAAADGTG
ORF15_pKS01    SLVAVHLAAQALRNGECTLALAGGVTVMSTPGTFTEFSRQRGLAADGRCKSFAAAADGTG
ORF15_pKS02    SLVALHMAIQALRTGECDMALAGGVTVMATPGTFIGFSRQRGLSADGRCRAFSADADGTG
ORF15_pKS03    SLVALHLAVQALRNGECSLALAGGVTVMATPAAFVEFSRQRGLAADGRCKAFSAGADGTG
ORF16_pKS01    SLVTLHLAVQALRAGECSMALAGGVTVMATPATFTEFSRQRGLAPDGRCKPFAAAADGTG
ORF16_pKS02    SLVALHLAVQALRSGECSLALAGGVTVMSTPGTFIEFSRQRGLSTDGRCKAFSSDADGFS
ORF17_pKS01    SLVALHLAVQALRNDECSLALAGGVTVMSSPRAFVQFSRQRGLAPDGRCKPFADGADGTG
ORF17_pKS02    SLVALHLAAQALRNGECDMALAGGVTVMSTPDTFIDFSRQRGLSGNGRCKSFSADADGTG
ORF17_pKS03    SLVALHLAVQALRNGECTLALAGGVTIITTPDVFTEFSRQRGLASDGRCKPFAEAADGTA
ORF17_pKS04    SLVALHWAIQALRNGECTMALAGGVTVMSTPGTFTEFSRQRGLAADGRIKSFAAAADGTS
ORF18_pKS01    SLVTLHLAMQALRKGECSLALAGGVTVMATPGTFTEFSRQRGLSFDGRCKSFADSADGTG
ORF18_pKS02    SLVTLHLAVQALRNGECDLALAGGVTVMATPGTFVAFSRQRGLASDGRCKPFAAAADGTA
               * .::* * **** ** :*:.... ::  *  : :*:* **: :** :.*:   ***
```

Figure 2c

```
ORF10_pKS01   WGEGVGMLLVERLSDARAKGHRILAVVRGSAINQDGASNGLTAPSGPSQQRVIRQALANA
ORF10_pKS02   WGEGVGMLLVERLSDARRNGHPVLAVVRGSAINQDGASNGLTAPNGPSQQRVIRQALAGA
ORF10_pKS03   WGEGVGMLLVERLSDARRNGHPVLAVVRGSAVNQDGASNGLTAPNGPSQQRVIRAALASA
ORF10_pKS04   WAEGAGMLLVERLSDAERNGHPVLAVVRGSAINQDGASNGLTAPNGPSQQRVIREALASA
ORF10_pKS05   WGEGVGMLLVERLSDARRNGHPVLALVRGSAINQDGASNGLTAPNGPSQQRVIRQALANA
ORF11_pKS01   WSEGVGVLLVERLSDARRNGHPVLAVVRGSAVNQDGASNGLTAPNGPAQQRVIRQALENA
ORF11_pKS02   WGEGVGMLLVERLSDARRNGHPVLAVVRGSAVNQDGASNGLTAPNGPSQQRVIRAALASA
ORF12_pKS01   WSEGAGVLLVERLSDARRNGHHILAVVRGSAVNQDGASNGLTAPNGPAQQKVIRQALESA
ORF12_pKS02   WSEGVGLLLVERLSDARRNGHPVLAVVRGTAVNQDGASNGLTAPNGPSQQRVIREALADA
ORF12_pKS03   WGEGVGMLLVERLSDAERNGHPVLAIVRGSAINQDGASNGLTAPNGPSQQRVIRAALASA
ORF12_pKS04   WGEGVGMLLVERLSDARRNGHPVLALVRGSAVNQDGASNGLTAPNGPSQQRVIRAALASA
ORF13_pKS01   PAEGVGVLLLERLSDARKNGRPVLAVVRGSAVNQDGASNGLTAPNGPSQQRVIRQALANA
ORF14_pKS01   LAEGVGILLVERLSDARRKGHPVLAVVRGTAVNQDGASNGLTAPNGPSQQRVILQALSNA
ORF14_pKS02   WGEGVGILLVERLSDAQRNGHPVLAIVRGSAINQDGASNGLTAPNGPSQQRVIRQALASG
ORF14_pKS03   WGEGAGMLLLERLSDARRNGHQVLAVVRGSAVNQDGASNGLTAPNGPSQQRVIRQALANA
ORF15_pKS01   WGEGAGMLVLERLSEARRNGHPVLALVRGSAVNQDGASSGLTAPNGPSQQRVIRQALAGA
ORF15_pKS02   WGEGVGMLLVERLSDARRNGHPVLAVVRGSAINQDGASNGLTAPNGPSQQRVIRAALASA
ORF15_pKS03   WSEGAGVLLVERLSDARRNGHPVLAVVRGSAINQDGASNGLTAPNGPSQQRVIRQALASA
ORF16_pKS01   WGEGVGMLLVERLSDAQRNGHPILAVVRGSAINQDGASNGLTAPNGPSQQRVIHQALTNA
ORF16_pKS02   PAEGVGVLLVERLSDARRNGHPILAVVRGSAINQDGASNGLTAPNGPSQQRVIRQALANA
ORF17_pKS01   WGEGVGMLLVERLSDARRNGHPVLALVRGSAINQDGASNGLTAPNGPSQQRVIRQALTNA
ORF17_pKS02   WAEGAGMILVERLSDARRNGHQVLAVVRGTAVNQDGASNGLTAPNGPSQQRVIRQALANA
ORF17_pKS03   WGEGVGMLLVERLSDARRNGHQVLAVVRGTAVNQDGASNGLTAPNGPSQQRVIRQALANA
ORF17_pKS04   WAEGAGMLLVERLSEARAKGHPVLAIVRGSAINQDGASNGLTAPNGPSQQRVIRQALAGA
ORF18_pKS01   WAEGAGMLLVERLSDARKNGHTVLAVVRGSAVNQDGASNGLTAPNGPSQQRVIRQALADA
ORF18_pKS02   WGEGVGMLLVERLSDARAKGHPVLAVVRGSAINQDGASNGLTAPNGPSQQRVIRQALASA
              .**.*:::.****:*. :*: :**:***:*:******.*****.**:**:** **  ..

ORF10_pKS01   GLSAAEVDVVEAHGTGTRLGDPIEAQALLATYGQEHTDDRPLWLGSLKSNIGHTQAAAGV
ORF10_pKS02   GLSAADVDAVEAHGTGTRLGDPIEAQALLATYGQGRPADRPLWLGSVKSNIGHTQAAAGV
ORF10_pKS03   GLSAADVDVVEAHGTGTKLGDPIEAQALLATYGQDRPAGRPLWLGSIKSNIGHTQAAAGV
ORF10_pKS04   DLSAADIDAVEAHGTGTRLGDPIEAQALLATYGREREAGRPLWLGSIKSNIGHTQAAAGV
ORF10_pKS05   GLSAAEVDVVEAHGTGTRLGDPIEVQALLATYGQDRPLEGRPLWLGSIKSNIGHTQAAAGV
ORF11_pKS01   RLSAAEVDVVEAHGTGTTLGDPIEAQALLATYGQDRPEGRPLRLGSLKSNIGHTQAAAGV
ORF11_pKS02   GLSAADVDVVEAHGTGTKLGDPIEAQALLATYGQDRPDGRPLWLGSIKSNIGHTQAAAGV
ORF12_pKS01   RLTPADIDAVEAHGTGTTLGDPIEAQALLATYGQGRTDGRPLWLGSLKSNLGHTQNAAGV
ORF12_pKS02   GLSAAEVDAVEAHGTGTTLGDPIEAQALLATYGQGRPDDQPLWLGSVKSNIGHTQAVAGA
ORF12_pKS03   GLSAADVDVVEAHGTGTTLGDPIEAQALLATYGQDRPADRPLQLGSIKSNIGHTQAAAGV
ORF12_pKS04   GLAPGDIDAVEAHGTGTKLGDPIEAQALLATYGQDRPADRPLQLGSIKSNIGHTQAAAGV
ORF13_pKS01   RLSTDQVDVVEAHGTGTSLGDPIEAQALIATYGQDRPADQPLLLGSVKSNIGHTQAAAGV
ORF14_pKS01   RLTPDQVDAVEAHGTGTGLGDPIEAQALIATYGQDRPDGRPLWLGSLKTNIGHAQAAAGV
ORF14_pKS02   GLTTMDVDAVEAHGTGTKLGDPIEAQALLATYGQDRPEGRPLLLGSIKSNLGHTQAASGV
ORF14_pKS03   GVAAGHVDAVEAHGTGTTLGDPIEAQALLATYGQEHTDDRPLLLGSVKSNIGHTQAASGV
ORF15_pKS01   RLSATQVDAVEAHGTGTTLGDPIEAQALLATYGQDRPDGRPLWLGSIKSNMGHTQAAAGI
ORF15_pKS02   GLSAAEVDAVEAHGTGTTLGDPIEAQALLATYGREHTEDSPLWLGSIKSNMGHTQAAAGV
ORF15_pKS03   GLSAADVDVVEAHGTGTTLGDPIEAQALLATYGQEHTDEQPLLLGSIKSNFGHTQAAAGV
ORF16_pKS01   RLSAADVDVVEAHGTGTTLGDPIEAQALLATYGQDRPAGRPLLLGSIKSNIGHTQAAAGV
ORF16_pKS02   RLSAADVDVVEAHGTGTTLGDPIEAQALLATYGQDRPAGRPLLLGSIKSNIGHAQAAAGV
ORF17_pKS01   GLTPAQVDVVEAHGTGTTLGDPIEAQALLATYGQNRPEGRPLWLGSVKSNIGHTQAAAGV
ORF17_pKS02   GLTTAEVDVVEAHGTGTTLGDPIEAQALLATYGQDRPAGQPLRLGSIKSNIGHTQAAAGA
ORF17_pKS03   GLTAAEVDAVEAHGTGTRLGDPIEAQALLATYGQDRPEGSPLWLGSIKSNFGHTQAAAGV
ORF17_pKS04   RLTSDQIDVVEAHGTGTTLGDPIEAQALLATYGREREADQPLWLGSIKSNMGHTQAAAGV
ORF18_pKS01   RLTAADVDVVEAHGTGTTLGDPIEAQALLATYGREHTEDSPLWLGSVKSNLGHTQAAAGV
ORF18_pKS02   GLSAADVDVVEAHGTGTTLGDPIEAQALLATYGQEHTDDSPLWLGSIKSNFGHTQAAAGV
              ::. ..:*.***.****.****** .***:****: :   ** ***:*:*:*H:* .:*
```

Figure 2d

```
ORF10_pKS01    AGIIKMIMAMRHGVLPRTLHVDAPTPHVDWEAGAVTLLTEAVEWPESDRPRRAGVSSFGM
ORF10_pKS02    AGVMKMVMAMRHGVLPRTLHVDGPTPHVDWSAGDVALLTEQREWPATGHPRRAGVSSFGL
ORF10_pKS03    AGIIKMVLAMQHGVLPQTLHVDEPTPHVDWSAGEVTLLTEQTAWPTVDRPRRAGVSSFGI
ORF10_pKS04    AGIIKMVMAMRHGVLPQTLHVDEPSPQVDWEAGEVSLLTGAMPWPQTGRPRRAGVSSFGI
ORF10_pKS05    AGVIKMVLAMEHGVLPQTLHVDEPTPHVDWSAGDVALLTDAVEWPETGRPRRAGVSSFGF
ORF11_pKS01    AGIIKMVMAMRHGVLPQTLHVDEPTPNVDWTAGAVSLLTEPMPWPETGAPRRAAVSAFGV
ORF11_pKS02    AGIIKMVMAMRHGVLPRTLHVDEPTSHVDWSAGEVSLLSESAEWPLTERPRRAGVSSFGI
ORF12_pKS01    AGIIKMVMAMRHGVLPRTLHVDEPTSHVDWSTGAVALLTEPVEWPETGRPRRVGVSAFGV
ORF12_pKS02    AGIIKMVMAMRHGVLPQTLHIDEPTPYVDWSAGDIALLTEQRAWPETGRPRRAGVSSFGY
ORF12_pKS03    AGVIKMVLAMEHGVLPQSLHIDAPSPQVDWEAGDIALLTEQRQWPETGRPRRAGVSSFGF
ORF12_pKS04    AGLMKMVLAMQHGVLPQTLHVDEPTPHVDWSAGDIALLTERREWPETGRPRRAGISSFGV
ORF13_pKS01    AGVIKMVLAMQHGVLPQSLHIDEPSPHVDWESGAVSLLTEQTAWPETTHPRRAGVSSFGF
ORF14_pKS01    AGVIKSVMAMRHGVLPRTLHVDEPTPEVDWSAGDVSLLTEARPWPLGDQPRRIGVSSFGM
ORF14_pKS02    AGVMKMVLAMQHGVLPQTLHVDEPTPHVDWSAGDVALLADAVAWPETGRPRRAGVSSFGI
ORF14_pKS03    AGVIKMVMSMRHGVLPKTLHVDEPTPHVDWSAGAVSLLTEQTPWPETGRPRRAGVSSFGI
ORF15_pKS01    AGIIKMVMAMRHGILPKTLHVDEPTPNVDWSEGAVSLLTESVPWPETGAPRRAGVSSFGI
ORF15_pKS02    AGVIKMVLAIQHGVLPRTLHADRPSPHVDWSQGAVSLLTESVPWPETGRPRRAGVSSFGI
ORF15_pKS03    AGIIKIVQAMRHGVVPKTLHVDEPTPHVDWSAGAVSLLTEQVAWPETGRPRRAAISSFGF
ORF16_pKS01    ASIIKMVEAMRHGVVPKTLHLDEPTPHVDWEAGAVSLIGEKIAWPETGELRRAGVSSFGF
ORF16_pKS02    AGVMKMVLAMQHGVLPQSLHIAEPTPHVDWSAGEVALLTEERAWPETGRPWRAGVSSFGF
ORF17_pKS01    AGIIKMVLAMQHGVLPESLHIDQPSGNVDWAAGDVKLLTEAVPWPQTGQPRRAGVSSFGV
ORF17_pKS02    AGIIKMILAMRHGVMPPSLHIGEPSPHIDWTAGAVSLLTEAAEWPDAGRPRRAGISSFGV
ORF17_pKS03    AGIIKMVQAMHHGVLPKTLHVDAPSPHVDWSAGAVSLLTEQMAWPETGRPRRAGVSSFGM
ORF17_pKS04    AGIIKMIMAIRHGVLPKTLHVDEPTPHVDWEAGAVSLLTESVPWPETGRPRRAGVSSFGI
ORF18_pKS01    AGIIKMVMAIRHGRIPKTLHVDEPSTNVDWSAGAVSLLRESVEWPETGRPRRAAISSFGI
ORF18_pKS02    AGIKMVQAMHHGVVPKTLHVDEPSPHVDWSAGAVSLLTEQMAWPETGRPRRAAISSFGI
               *.::*  :  ::.**  :* :**     *:   :**   * : *:        **       *   ..:*:**
```

```
ORF10_pKS01    SGTNAHVIVEEP
ORF10_pKS02    SGTNAHTIIEEA
ORF10_pKS03    SGTNAHTIIEQA
ORF10_pKS04    SGTNAHTIIEQP
ORF10_pKS05    SGTNAHTVLEQA
ORF11_pKS01    SGTNAHTIIEQA
ORF11_pKS02    SGTNAHTIIEQA
ORF12_pKS01    SGTNVHTIIEQA
ORF12_pKS02    SGTNAHAVIEQA
ORF12_pKS03    SGTNAHTIIEQA
ORF12_pKS04    SGTNAHTILEQA
ORF13_pKS01    SGTNAHVIVEQA
ORF14_pKS01    SGTNAHIILESA
ORF14_pKS02    SGTNAHTIIEQA
ORF14_pKS03    SGTNAHAIIEQA
ORF15_pKS01    SGTNAHTILEQA
ORF15_pKS02    SGTNAHTIIEQA
ORF15_pKS03    SGTNAHAIIEQA
ORF16_pKS01    SGTNAHVIVEQA
ORF16_pKS02    SGTNAHAIIEQA
ORF17_pKS01    SGTNAHTVIEQA
ORF17_pKS02    SGTNAHVIIEQP
ORF17_pKS03    SGTNAHAIIELA
ORF17_pKS04    SGTNAHTIIEQA
ORF18_pKS01    SGTNAHTIIEQA
ORF18_pKS02    SGTNAHTIIEQA
               ****.*  ::*  .
```

Figure 3a

```
ORF10_pAT01    VLLPWALSAKTPEALRAQAR-------RLGTLIAAQP--HVTPL---DIGHSLATTRGRF
ORF10_pAT02    SVLPLLISAKSDAGLRAQSE-------QLATHLVGNP--DVPIG---DIAYSLTTGRSGL
ORF10_pAT03    LPLPYVLSAKSPEALRAQAS-------VLRTHLEATD--HNGPG-SDDLAFSLATARAHL
ORF10_pAT04    PVVPWVLSGKGEEALRAQAR-------QLQSYVLRAP--ELRPV---DIAGSLAVGRASF
ORF10_pAT05    GVMPWTLSAKSEAALRVQAE-------RLRTRIA-----SDPLLQPVDVAYSLATSRAAL
ORF11_pAT01    AVLPWTLSGRSTAALRAQAA-------RLLTTQGQDG--ATEPGRPLDIGYSLATTRAAL
ORF11_pAT02    GTVPYVLSAKSSDALRAQAR-------QLLAVVEAAE--SPRVA---DLAYSLATSRAGL
ORF12_pAT01    KALPWLLSAKGRDALRDRAA-------QLLAYAEEHP--DLRPV---DIAGSLAVGRPSF
ORF12_pAT02    PVLPLLVSGRTAPALRAQAERLRPAATALATGTVTNSG-ALEAL---DLGYSLATSRAAL
ORF12_pAT03    DFVPLMLSAKSDVALRAQAA-------SLRARLIAAP--DMRLS---DVGSTLTTGRSAF
ORF12_pAT04    AVSAWPLAGKTEAGLREQAE-------RLLAHIDAHS--ELR---PVDVGHSLATGRAAF
ORF13_pAT01    -VVPWVLSGKSAGALRAQAE-------RLSGFLAGASAVDVPSV---DVGWSLASSRAGL
ORF14_pAT01    GALPVVLSGRTEPALRAQAA-------ALHAHLAAHP--GLGIA---DLAFSQALTRAAL
ORF14_pAT02    GPQPWLLSAKTRDALHDQAR-------RLHAHAELNP--ELSPA---DLGLSLAAGRSAF
ORF14_pAT03    SSVPLIVSARGEDALRAQAR-------RLHAHVHADP--GLRAV---DLGLSLATTRSAL
ORF15_pAT01    VPPLWTLSAKSPAALRAQAG-------KLHAHLTAHP--GLRPG---DIAHSLAVGRTDF
ORF15_pAT02    SALPLQLAGRSAEALSAQAR-------ALSAHLT-----AHPDVPLADLAYSLATSRATF
ORF15_pAT03    GSLPWLLSAKGADALRDQAA-------RLRAHAIGHP--ELSLA---DIGYALATSRTAL
ORF16_pAT01    -VVPWVLSGKSAGALRAQAE-------RLSGWLAGASAAGVASV---DVGWSLASSRAGL
ORF16_pAT02    -VLPWTLTAKTEKALQGQAE-------RLLTQLT--TRSDLRLV---DVGHSLATTRTAL
ORF17_pAT01    GPVPVLVSGQSDAALRAQAE-------RLAAHLRAHPGLGADTGTLTDLGFSLATSRSSL
ORF17_pAT02    TPLPFALSGRTPAALRAQAA-------RLIGHLAPRP--EAAPA---DVALSLATTRTAL
ORF17_pAT03    AALPWNLSARTPDALRAQGE-------RLLSHLETHCE-THPETVLADIGHSLTTGRALF
ORF17_pAT04    RVLPFVLSAKSAGALRGQAV-------RLKAHVEASP--EVSGAGAVDVAYSLATRRAVF
ORF18_pAT01    PVLPWPVSARTEEALHAQAE-------RLLAHVR-----TNPDQAPVGVALSLATGRAAL
ORF18_pAT02    RVLPFVLSAKSAGALRGQAV-------RLKAHVEASP--EVSGAGAADVAYSLATRRAVF
                 ::.:    .*  :.             *                .:.  :  *   :

ORF10_pAT01    EQRAIVLGDD---REAFLDALHALAEGN--------DTPSVVQGAA-APGKLAFLFTGQG
ORF10_pAT02    ETRAILVGDADN-RTGLAAALRSLAAGE--------QAPGLVQGTV-TEGGLAFLFTGQG
ORF10_pAT03    EHRAVLT-ADD--PQEFREALARLADGD--------PSPRITTGAV-SDGRTAFLFTGQG
ORF10_pAT04    EDRAAVV--AAD-REGLLAALAALADGG--------SATGAVEGSA-VGGKLAFLFTGQG
ORF10_pAT05    ERRAVVVATE---RDEFLAGLKALASGQ--------PAPGLVQGR-VTEGGLAFLFTGQG
ORF11_pAT01    EHRAVLL-GRT--EDDFAAALSALAEGA--------ESAGLVQGRV-TEGGLAFLFTGQG
ORF11_pAT02    DHRAALVADD---RENLTRALAALAADE--------QVPGLVRGTA-TGGGLAFLFTGQG
ORF12_pAT01    EDRAAVV--AAD--REGLLAGLAALADGG-------SATGLVKGSSQLVGKLAFLFTGQG
ORF12_pAT02    EHRAVLIGTPSD-GQALASRLDALAAGE--------QVPGLVQGTA-SGGGLAFLFTGQG
ORF12_pAT03    ERRAALV--AGG-REGLLAGLEALADGG--------SAAGLVEGSP-VSGKLAFLFTGQG
ORF12_pAT04    DHRAVLVAGDD--RSEFRRALAALASGE--------SVAQVVQGIARPDQQVAFLFTGQG
ORF13_pAT01    EHRAVVLG-------DHAAGVAAVASGV--------MAAGVVTGSV-VGGKTAFVFPGQG
ORF14_pAT01    DRRAAVVADD---RDALLAGLAALAEGR--------PSADVVEGSA-TDGKLAFLFTGQG
ORF14_pAT02    ERRAAVI-AAD--RDGLLAGLAALADGG--------AAAGLVEGSP-VAGKLAFLFTGQG
ORF14_pAT03    EQRAALVAGD---RAELLRGLDALARGE--------DTAGLVRGTA-REGQVAFLFTGQG
ORF15_pAT01    EHRAVLT-SADG-PVGLVRALEALADSAPEDTAPADRAPGVTRGRP-VAGKLAFLFTGQG
ORF15_pAT02    DHRAVLVATEGTTAATAVTALDALADRR--------TAPGLVRGTASKGGRTAFLFTGQG
ORF15_pAT03    DRRAAVVAGD---REEFLAGLAALAEGA--------TAAGLTEGSP-AGGKLAFLFTGQG
ORF16_pAT01    EHRAVVLG-------DHAAGVGAVASGV--------MAAGVVTGSV-VGGKTAFVFPGQG
ORF16_pAT02    DQRAVLIGRDRP---DYLGALTALAAGD--------TSPLLVQGAV-VGGKTAFVFPGQG
ORF17_pAT01    DRRAVLFGDR----DSLLADLSALAEGE--------QPAGPVLGAV-GEGKTAFLFTGQG
ORF17_pAT02    DRRAAVIAHD---RTELLAGLTALAEGH--------DSARLVQHTA-ADGRTAILFTGQG
ORF17_pAT03    EHRATVVAGD---RDGFRAGLAALAEGR--------TAAGLIQGSSSTGGRTAFLFTGQG
ORF17_pAT04    DHRAVVVAGD---REELLRSLAAVESEG--------AAAGVTRGAVG-GGKLAFLFTGQG
ORF18_pAT01    EHRAVVVATD---RETALADLAALASGE--------TSARVVLGEPGARGKTAFLFTGQG
ORF18_pAT02    DHRAVVVAGD---REELLRALAAVESEG--------TAAGVTRGTAG-GGKLAFLFTGQG
                : **  :               :  :             .         *::*.*  *
```

Figure 3b

```
                                                                              M1
ORF10_pAT01    SQRLGMGRELYETHPVFADALDDACWYLDDQLELPL--LDVLFADEGSPEAALLHQTAYT
ORF10_pAT02    SQRLGMGRELYETYPVFADALDAVCARMD--LEVPL--RDVLFGAY----AGLLDETAYT
ORF10_pAT03    SQRLGMGRELYEAYPVFADALDAVCAHVDAHLEVPL--KDVLFGAD----AGLLDQTAYT
ORF10_pAT04    SQRLGMGRELYEAYPVFAEALDAVCAR----LELPL--KDVLFGAD----AGLLDETAYT
ORF10_pAT05    SQRLGMGRELYETYPVFADALDAVCVR----LELPL--MDVLFGTE----RDALDETGYT
ORF11_pAT01    SQRLGMGRELYETYPVFADALDAVCAR----LELPL--KDVLFGAD----AGLLDETAYT
ORF11_pAT02    SQRLGMGRELYETYPVFARALDAV----DARLELPM--KEVLFGAD----ADLLNETAHT
ORF12_pAT01    SQRLGMGRELYETYPVFAQALDAVCER----LELPL--KNVLFGTD----SAALDETSYT
ORF12_pAT02    SQRLGMGRELYETYPVFAEALDAVCAR----LELPL--KEVLFGAD----GAALDQTAVT
ORF12_pAT03    SQRLGMGRELYEAYPVFADALDAVCVR----LELPL--MDVLFGAD----AGLLNETAYT
ORF12_pAT04    SQRLGMGRELYETYPVFADALDAVCAR----LELPL--KDVLFGGD----ADRLNETAYT
ORF13_pAT01    SQWVGMAVGLLDSSPVFAARVEECAKALEPFTDWSL--VDVLRGVEG---APSLERVDVV
ORF14_pAT01    SQRPGMGRELYATYPVFAQALDAVCER----LELPL--KDVLFGTDGAA-GAALDETAYT
ORF14_pAT02    SQRLGMGRELYDTYPVFADALDAVCAHVDAHLEVPL--KDVLFGAD----TGLLDQTAYT
ORF14_pAT03    SQRPGMGRELYDAHPVFADALDEICGELDRHLEVPL--KGVLFATE----GDLIHQTAYT
ORF15_pAT01    SQRLGMGRELYETYPVFAQALDAVCERLN--LEVPL--RDVLFGAD----AGLLDQTVYT
ORF15_pAT02    SQRLGMGRELYEAHPVFARALDAVCDR----LELPL--KDVLFGTD----AGLLNETVYT
ORF15_pAT03    SQRLAMGRELYSAHPVFARALDAVCDG--LALDVPL--KQVLFGSD----ADLLDRTAYT
ORF16_pAT01    SQWVGMAVGLLDSSPVFAARVDECAKALEPFTDWSL--VDVLRGVEG---APSLERVDVV
ORF16_pAT02    SQWVGMAVALLDASPVFAARVDECAKALEPFTDWSL--RDVLRGVTG---APSLDRVDVV
ORF17_pAT01    SQRLGMGRELYATHPGFARALDEVRAELDQHLERPL--FDVLFAAEGTPEADLLDETAYT
ORF17_pAT02    SQRPGMGRELYETYPAFAEALDAVCAELDPHLEQPL--KEVLFTAD----GDLLNRTGRT
ORF17_pAT03    SQRLGMGRELYEAYPVFARALDEVCAR----LELPLPLKDVLFGTD----TGLLNETAYT
ORF17_pAT04    SQRLGMGRELYETYPVFARALDAACAR----LELPL--KDALFGTD----AGLLGETAYT
ORF18_pAT01    SQRLGMGRELYEEYPVFADALDAVCAR----LELPL--KDVLFGAD----ARLLDETAYT
ORF18_pAT02    SQRLGMGRELYETYPVFARALDAACAG----LELPL--KDALFGAD----AGLLDETAYT
               **  .*. *       * **   ::              : .:     .*        : ..  .

M2              M3
ORF10_pAT01    QPALFAVEVALFRLVDSWGLKPDFVAGHSIGEIAAAHVAGVFSLEDACMLVAARGRLMQA
ORF10_pAT02    QPALFAVEVALFRLVESWGLRPDFVAGHSIGEIAAAHVAGVLSLDDACALVEARGRLMGA
ORF10_pAT03    QPALFAVEVALFRLVESWGVKPDFVAGHSIGEIAAAHVAGVFSLQDASELVFARGRLMQA
ORF10_pAT04    QPALFAVEVALFRLVESWGLRPDFVAGHSIGEIAAAHVAGVLSLDDACALVEARGRLMGA
ORF10_pAT05    QPALFAVEVALFRLVESWGVRPDFLAGHSIGEIAAAHVAGVFSLDDACALVEARGRLMQA
ORF11_pAT01    QPALFAVEVALFRLVESWGVKPDFVAGHSIGEIAAAHVAGVFSLEDACALVSARGRLMGA
ORF11_pAT02    QPALFAVEVALFRLLESWGVRPDVLAGHSIGEIAAAHVAGVLSLDDACTLVEARGRLMQA
ORF12_pAT01    QPALFAVEVALFRLVESWGLKPDFLAGHSIGEIAAAHVAGVFSLDDACALVSARGRLMGA
ORF12_pAT02    QPALFAIEVALFRLVESWGLRPDFVAGHSIGEIAAAHVAGVFSLEDACRLVEARGRLMGA
ORF12_pAT03    QPALFAVEVALFRLVESWGLRPDFLAGHSIGEIAAAHVAGVLSLDDACALVEARGRLMGA
ORF12_pAT04    QPALFAVEVALFRLVESWGVRPDFLAGHSIGEIAAAHVAGVFSLDDACALVEARGRLMQA
ORF13_pAT01    QPALFAVMVSLAEVWRAAGVRPGAVIGHSQGEIAAACVAGILSLEDAARVVALRSQAIGR
ORF14_pAT01    QPALFAVEVALFRLVESWGLKPDYLAGHSIGEIAAAHVAGVFSLEDACTLVEARGRLMQA
ORF14_pAT02    QPALFAVEVALFRLVESWGLRPDFLAGHSIGEIAAAHVAGVFSLQDASELVVARGRLMGA
ORF14_pAT03    QPALFAVEVALFRLLESRGVQPDFLAGHSIGEIAAAHVAGVFSLQDASELVAARGRLMQA
ORF15_pAT01    QTALFAVEVALFRLVESWGLKPDFLAGHSIGEIAAAHVAGVFSLEDACALVSARGRLMGA
ORF15_pAT02    QPGLFAVEVALFRLVESWGVKPDFLAGHSIGEIAAAHVAGVLSLDDVCALVEARGRLMGA
ORF15_pAT03    QPALFAVEVALFRLVESWGLKPDFLAGHSIGEITAAHVAGVLSLDDACTLVAARGRLMQA
ORF16_pAT01    QPALFAVMVSLAEVWRAAGVRPGAVIGHSQGEIAAACVAGILSLEDAARVVALRSQAIGR
ORF16_pAT02    QPALFAVMVSLAEVWRAAGVRPDAVIGHSQGEIAAACVAGILSLEDAARVVALRSQAIGR
ORF17_pAT01    QSALFAVEVALFRQLEQWGVGADFLIGHSIGELAAAHVSGVFTLADAAKLVAARGRLMQA
ORF17_pAT02    QPALFALETALYRLVESWGRPDFVAGHSIGEITAAHVAGVLSLPDAATLVAARGRLMQE
ORF17_pAT03    QPALFAVEVALFRLVESWGLKPDFLAGHSIGEIAAAHVAGVLSLEDACALVSARGRLMGA
ORF17_pAT04    QPALFAVEVALFRLLESWGVRPDFLAGHSIGEIAAAHVAGVLSLDDACALVEARGRLMGA
ORF18_pAT01    QPALFAVEVALFRLVESWGLKPDFLAGHSIGEIAAAHVAGVFSLEDACALVSARGRLMGA
ORF18_pAT02    QPALFAVEVALFRLLESWGVRPDFLAGHSIGEIAAAHVAGVLSLDDACALVAARGRLMQA
               *..***:  ..:*   *:  ..  : **  **::**  *:*::: *  ..  *    .: :
```

Figure 3c

```
ORF10_pAT01    LPAG-GVMIALQASEDEVLPLLT----DRVSIAAINGPQAVVIAGDEDAAAAIAETFQAA
ORF10_pAT02    LPGG-GVMIAVQAPEAEVLPLLT----ERVSIAAINGPQSVVIAGDEADAVAIVESFTG-
ORF10_pAT03    LPTG-GVMIAVQASEDEVLPLLT----DRVSIAAINGPQSVVIAGDEADAVAIAESFTD-
ORF10_pAT04    LPAG-GVMIAVQASEDEVLPLLT----DRVSIAAINGPRSVVIAGDEADAVAIVESFTG-
ORF10_pAT05    LPTG-GVMIAVQASEAEVLPLLT----ERVSIAAINGPQSVVIAGDEADAVALVESFTG-
ORF11_pAT01    LPAG-GVMIAVQASEAEVLPLLT----DRVSIAAINGPQSVVIAGDEADAVAIAGSFAD-
ORF11_pAT02    LPTG-GVMIAVQASEDEVLPLLT----GQVSIAAINGPQSVVIAGDEADAVAIAESFTD-
ORF12_pAT01    LPGG-GVMIAVQASEDEVLPLLT----DRVSIAAINGPQSVVIAGDEADAVAIAESFAD-
ORF12_pAT02    LPGG-GVMIAVQASEDEVLPLLT----DRVSIAAINGPQSVVIAGDEADAVAIAESFTG-
ORF12_pAT03    LPAG-GVMIAVQASEDEVLPLLT----DRVSIAAINGPQSVVIAGDEADAVAIVESFTG-
ORF12_pAT04    LPTG-GVMIAVQASEAEVLPLLT----ERVSIAAINGPQSVVIAGDEADAVAIVDAFND-
ORF13_pAT01    VLAGLGGMVSVPLPAKAVRELIAPWGEGRISVAAVNGPSSVVVSGEAAALDELLVSCESE
ORF14_pAT01    LPTG-GVMIAVEASEDEVLPLLT----DWVSIAAVNGPRSVVVAGDEDAAVAIAEAFAAQ
ORF14_pAT02    LPTG-GVMIAVQASEDEVLPLLT----DRVSIAAINGPQSVVIAGDEADAVAIAESFTG-
ORF14_pAT03    LPTG-GVMIAVQASEDEVLPLLT----DRVSIAAINGPQSVVIAGDEADAVAIAESFTD-
ORF15_pAT01    LPGG-GVMIAVQASEDEVLPLLT----DRVSIAAINGPQSVVIAGDEADAVAIAESFAD-
ORF15_pAT02    LPGG-GVMIAVQASEAEVLPLLT----DRVSIAAINGPRSVVIAGDEADAVAIVESFTD-
ORF15_pAT03    LPTG-GVMIAVEASEDEVLPLLT----DRVSIAAINGPQSVVIAGDEADAVAIAESFTG-
ORF16_pAT01    VLAGLGGMVSVPLPAKAVRELIAPWGEGRISVAAVNGPSSVVVSGEAAALDEMLASCESE
ORF16_pAT02    VLAGLGGMVSVALPAKAVRELIAPWGEDRISVAAVNGPSSVVVSGETAALDELLASCESD
ORF17_pAT01    LPAD-GAMIAVEATEDEVAPLLT----GRVSIAAVNGPRSVVVSGDEDAATALAETLRAR
ORF17_pAT02    LPEG-GAMIALTATEDEVLPLLAGH-EDRIGIAAVNSASSVVISGEEGLALEIAAEFERR
ORF17_pAT03    LPGG-GVMIAVQASEGEVLPLLT----DRVSIAAINGPQSVVIAGDEADAVAIVESFSD-
ORF17_pAT04    LPTG-GVMIAVQASEAEVLPLLT----DRVSIAAINGPQSVVIAGDEADAVAIVESFSG-
ORF18_pAT01    LPAG-GVMIAVQASEDEVLPLLT----ARVSIAAINGPQSVVIAGDEADAVAIVESFTG-
ORF18_pAT02    LPTG-GVMIAVQASEDEVLPLLT----DRVSIAAINGPQSVVIAGDEADAVAIVESFSG-
                 . * *:::  .   * *::       :..:**:*..  :**::*:          :

M4
ORF10_pAT01    GRKTKRLTVSHAFHSPHMDAMLEEFLRVAQVLDYAKPTLPVVSLLTGTTATPAELATPAY
ORF10_pAT02    -RKSKRLTVSHAFHSPHMDGMLEDFRAVAEGLSYEAPRIPVVSNLTGALVS-DEMGSAEF
ORF10_pAT03    -RKSKRLTVSHAFHSPHMDGMLDAFREIAEGLSYEPSRIPVVSNLTGALVS-DEMGSAEF
ORF10_pAT04    -RKSKRLTVSHAFHSPHMDGMLEDFRAVAEGLSYEAPRIPVVSNLTGTLVT-DEMGSAEF
ORF10_pAT05    -RKSKRLTVSHAFHSPHMDGMLADFRKVAEGLSYEAPRIPVVSNLTGALVT-DEMGSADF
ORF11_pAT01    -RKSKRLTVSHAFHSPHMDGMLEDFRLVAEGLSYEAPRIPVVSNLTGALVS-DEMGSAEF
ORF11_pAT02    -RKSKRLTVSHAFHSPHMDGMLADFRKVAEGLVYENPRIPIVSNLTGTLVT-DEMASADF
ORF12_pAT01    -RKSKRLTVSHAFHSPHMDGMLEDFRVVAEGLSYEAPRIPVVSNLTGALVS-DEMGSADF
ORF12_pAT02    -RKSKHLAVSHAFHSPHMDGMLEDFRAVAEGLSYEAPRIAVVSNLTGALVS-DEMSSAEF
ORF12_pAT03    -RKSKRLSVSHAFHSPHMDGMLEDFRVVAEGLSYDAPRIPVVSNLTGALVT-DEMGSADF
ORF12_pAT04    -RKSKRLAVSHAFHSPHMDGMLADFRKVAEELSYEAPRIPIVSNLTGALVT-DEMGSADF
ORF13_pAT01    GVRAKRIAVDYASHSAQVELLREELAELLAPIVPRAAEVPFLSTVTGEWVRGPELDGG-Y
ORF14_pAT01    GRKTKKLTVSHAFHSPHMDGMLDAFRTVAQGLSYGTPRIPVVSNLTGALVT-DEMGSADF
ORF14_pAT02    -RKSKRLTVSHAFHSPHMDGMLEDFRAVAEGLSYEAPRIPVVSNLTGALIS-DEMGSAEF
ORF14_pAT03    -RKSKRLTVSHAFHSPHMDGMLADFRKVAEGLVYENPRIPVVSNLTGALVT-DEMGSADF
ORF15_pAT01    -RKSKRLTVSHAFHSPHMDAMLEDFRAVAEGLSYEAPRIPVVSNLTGALVS-DEMGSADF
ORF15_pAT02    -RKSKRLTVSHAFHSPHMDAFREIAEGLSYEAPRIPVVSNLTGALVS-DEMGSADF
ORF15_pAT03    -RKSKRLTVSHAFHSPHMDGMLEDFREVAEGLSYGTPLIPVVSHLTGTLVT-DEMRSPDF
ORF16_pAT01    GVRAKRIAVDYASHSAQVELLREELAELLAPIVPRAAEVPFLSTVTGEWVRGPELDAG-Y
ORF16_pAT02    GVRAKRIAVDYASHSAQVELLREELAELLAPIVPRAAEVPFLSTVTGEWVRGPELDGG-Y
ORF17_pAT01    GRRTKRLTVSHAFHSPLMDGMLDAFREVAESVAYAPPVIPIVSNLTGASVTAEEICAADY
ORF17_pAT02    GRRTKRLTVSHAFHSPLMDGMLDAFREVAESLTYRAPAIPVVTLLTGTVAG-DELRTAEH
ORF17_pAT03    -RKSKRLTVSHAFHSPHMDGMLDDFRAVAEGLSYGAPRIPVVSNLTGALVS-DEMGSADF
ORF17_pAT04    -RKSKRLTVSHAFHSPHMDGMLAGFRKVAESLSYEAPRIPVVSNLTGALVT-DEMGSADF
ORF18_pAT01    -RKSKRLTVSHAFHSPHMDGMLEDFRVVAEGLSYEAPRIPVVSNLTGALVS-DEMGSADF
ORF18_pAT02    -RKSKRLTVSHAFHSPHMDGMLAGFRKVAESLSYEAPRIPVVSNLTGALVT-DEMGSADF
                 :*:::*..:*  *. ::  :    :     :      .  :..::  :**       *:   .
```

Figure 3d

```
ORF10_pAT01    WVRHVRDAVRYLDGVRTLHQRGVRTFLELGPDAVLTAMAQDCVDP-----QGAAFAPALR
ORF10_pAT02    WVRHVREAVRFLDGMRVLEAAGVTTYVELGPGGVLSALAQECVSG-----DGAAFVPVLR
ORF10_pAT03    WVRHVREAVRFLDGIRTLEAAGVTKYVELGPDGVLSAMAQDCVSG-----EGSVFIPVLR
ORF10_pAT04    WVRHVREAVRFLDGIRALEAAGVTTYVELGPGGVLSALAQECVSG-----DGAAFVPVLR
ORF10_pAT05    WVRHVREAVRFLDGTRTLEALGVTTYVELGPDGVLSAMAQECVTG-----EDSVFVPVLR
ORF11_pAT01    WVRHVREAVRFLDGIRTLEAAGVTKYVELGPDGVLSAMAQDCVSG-----EGSVFIPVLR
ORF11_pAT02    WVRHVREAVRFLDGIRALESRGVTTYIELGPDGVLSALAQDCLTAGTG-TGTAIFAPVLR
ORF12_pAT01    WVRHVRETVRFLDGIRTLEAAGVTKYVELGPDGVLSALAQDCVSG-----EDSVFIPVLR
ORF12_pAT02    WVRHVREAVRFLDGIRALEAAGVTTYVELGPGGVLSALAQECVSG-----DGAAFVPVLR
ORF12_pAT03    WVRHVREAVRFLDGIRALEAAGVTTYVELGPDGVLSAMAQECVTE-----GGAAFVPVLR
ORF12_pAT04    WVRHVREAVRFLDGIRALEAAGVTVYVELGPDGVLSAMAQECVTG-----EGAAFVPALR
ORF13_pAT01    WFQNLRRTVELEEATRTLLEQGFGVFVESSPHPVLSVGMQETVEDAG---REAAVLGSLR
ORF14_pAT01    WVRHVREAVRFLDGIRWLESRGVTTYIELGPGGVLSALGQDCQTATG--PRAAAFLPALR
ORF14_pAT02    WVRHVREAVRFLDGIRTLEAAGVTKYVELGPDGVLSAMAQDCVSG-----EGSVFIPVLR
ORF14_pAT03    WVRHVREAVRFLDGIRALEAAGVTTHIELGPDGVLCAMAQECVSG-----EDTVFVPVLR
ORF15_pAT01    WVRHVRETVRFLDGIRALTERNVVHFVELGPDAVLSAMAQDCPSA-----DTAAFVPVLR
ORF15_pAT02    WVRHVREAVRFLDGIHALEAAGVTTYVELGPDGVLSAMAQECVTG-----EDSVFVPVLR
ORF15_pAT03    WVRHVREAVRFLDGIRTLEDAGVTTYIELGPGGVLSAMGQSCVTR-----DDAAFLPALR
ORF16_pAT01    WFQNLRRTVELEEATRTLLEQGFGVFVESSPHPVLSVGMQETVEDAG---REAAVLGSLR
ORF16_pAT02    WFQNLRRTVELEEATRTLLEQGFGVFVESSPHPVLTMGVQETVEDAG---RDAAVLGSLR
ORF17_pAT01    WVRHVREAVRFLDGVRKLSAQGCVTTFVEVGPGGVLSGLGRDCLTDPADPADTAVFVPALR
ORF17_pAT02    WVSHVREAVRFLDGIRTLDAEHVTTYLELGPQGVLSGLGRDCLTDPADPADTAVFVPALR
ORF17_pAT03    WVRHVREAVRFLDGIRALEAAGVTTYIELGPDGILSAMAQECITG-----EGAAFAPVLR
ORF17_pAT04    WVRHVREAVRFLDGIRTLEAAGVATYVELGPDGVLSAMAQDCVTG-----EGAAFAPALR
ORF18_pAT01    WVRHVREAVRFLDGIRALEAAGVTTYVELGPDGVLSAMAQACVTG-----ENSVFVPVLR
ORF18_pAT02    WVRHVREAVRFLDGIRALEAAGVTAYVELGPDGVLSALAQECVTG-----EGAAFAPALR
               *. ::* :*.    :. :  *         . .:* .*  :*         :  .   **

ORF10_pAT01    SGRPEAATVLNAVAHAHVRGAETDWAAFFAGTGAQRVDLPTYAFQRQRYWM--
ORF10_pAT02    SGRPEAETAVTALAQAHVRGVDVDWAAFFSGTGVQRVDLPTYAFQRQRFWP--
ORF10_pAT03    KARPEAESVTTALASAHVHGIPVDWQAYFAGTGAQRVDLPTYAFQRQRYWP--
ORF10_pAT04    SGRSEAETAVTALAQAHVRGVNVDWAAFFAGTGAERVDLPTYAFQRQRYWL--
ORF10_pAT05    SGRPEAESVTTALAQVHVRGIAVDWQAYFAGTGAQRVDLPTYAFQRRRYWL--
ORF11_pAT01    KARPEAESVTTALATAHVHGIPVDWQAFYAGTGAQRVDLPTYAFQHERYWL--
ORF11_pAT02    AARPEAESVTTALATAHVHGTPVDWRAYFAGTGARRADLPTYPFQGRRYWP--
ORF12_pAT01    KARPEAETVATALASAHVHGIPVDWRAYFAGTGAQRVDLPTYPFQRQRYWI--
ORF12_pAT02    SGRSEAETVVTALAQAHVRGVEVDWAAFFAGEARIDLPTYAFQRQRYWP--
ORF12_pAT03    KGRPEAETVMATLGQAHVRGVAVDWHSVYG-TGAQRVDLPTYSFQRQRYWP--
ORF12_pAT04    KGRPEAETITAALAHAHTHGIAVDWQAYFAGTGAQRVDLPTYAFQRQRYWV--
ORF13_pAT01    RGEGGLERFWLSLGEAWVRGVGVDWHAVFAGTGAQRVDLPTYAFQSQRFWPEA
ORF14_pAT01    TGRPEASSLTAAVAGAHVRGLSPDWTVRFAGTGAQRVELPTYAFQRELYWP--
ORF14_pAT02    KARPEPESVTTALTTAHVHGIPVDWQAFFAGTGAQRVDLPTYAFQRQRYWP--
ORF14_pAT03    PGRPEAETVTTALARVHVQGVPVDWQAYFSGTGAQRVDLPTYAFQRKRYWL--
ORF15_pAT01    KGRSETGSLTDALARLHVGGVAVDWDAYYSGTDVQRVDLPTYAFQRAHYWL--
ORF15_pAT02    SGRPEAESVTTALAQAHVRGIAVDWQAYFAGTSAQRVDLPTYRFQREHYWP--
ORF15_pAT03    ADRSEEETLTSAVARAHLRGITVDWDAYYSGTGARRVDLPTYAFQRQRYWL--
ORF16_pAT01    RGEGGLERFWLSLGEAWVRGVAVDWHAVFAGTGARRVDLPTYAFQQEHYWLES
ORF16_pAT02    RGEGGLERFWLSLGEAWVRGVGVDWSAVFAGTGARRVDLPTYAFQSQRFWPEA
ORF17_pAT01    GDRPEAAAFATAVAQAHVHGVAVDWSAVFAGRGATRIDLPTYAFQRELYWP--
ORF17_pAT02    RDRGEAEALTAAIAAAHTRGVPLDWSAYFAGTGARRVELPTYAFQRERFWL--
ORF17_pAT03    AGRDEAETVLSALAAAHVRGVPVDWQAFYAPAGAQRVPLPTYAFQRSVYWL--
ORF17_pAT04    KGRPETETITTALALAHAHGTSVDWETYFAGTGAQGVELPTYAFQRDWYWL--
ORF18_pAT01    SGRSEAESVTTALAQAHVRGIAVDWQAYFAGTGAERVDLPTYAFQRDHYWL--
ORF18_pAT02    KGRPEAETITTALALAHNHGTSVDWETYFSGTGAQRVDLPTYAFQRERYWI--
               .         ::    *  **    :. ..  **** **    :*
```

Figure 4

```
ORF10_pDH03    IGLGDAGHPLLGAAVALADSEGVLFTGRLSLDTHPWLADHTILGSVLLPGTAFVDLAIRA
ORF11_pDH01    AGLDPAGHPLLGAAVTLAGSDSVLFTGRLSLRTQPWLADHTVSGTTVLPGAAFVELAVRA
ORF12_pDH01    AGLEEAGHPLLGAAVPLADSEGFLFTGRLGRTSHPWLADHAVMDTVLLPGTAFVDLAVRA
ORF12_pDH04    AGIGSAGHPLLGAAVELPDSDGFLFTGRLSLRTHPWLADHVVADTVVVPGAAFVELAVRA
ORF14_pDH02    IGLDDTAHPLLSAGVALPESDGMVFAGRLALSTHAWLADHAILGSVLLPGTAFVELATRA
ORF14_pDH03    AGLDAADHPLLGATVSLPGSDGLVLTGRLALSTHPWLSDHTVMDTVLLPGTAFVELALRA
ORF15_pDH01    AGLGAAGHPLLGAAVALADLDGFLYTGRLSLDTHPWLADHAVMGSAVLPGTAFVELAIRA
ORF15_pDH02    LGLAAAGHPLLGAAVTLADADGCVLTGRLSLRTHPWLADHAVMGSVLLPGTALVELALHA
ORF15_pDH03    AGLGSAGHPLLGAAVELPDSDGFLFTGRLSLRTHPWLGDHRVAGTVLLPGAALLELAVRA
ORF17_pDH01    AGIGAADHPLLGAAIALADGDGHLFTGRLSLATHPWLADHTVMDTVLLPGTAFVELALQA
ORF17_pDH02    AGMGAAHHPLLGAAVALADGEGFLFTGRLSLDTHPWLADHAVMGNVLLPGTAFVELAIRA
ORF17_pDH03    AGLGATDHPLLSAAVELPDSDGFLFTGRLSLATHPWLADHAVLGSVLLPGTAFVELALRA
ORF17_pDH04    FGLGATDHPLLDATIELPDSDGFLFTSRLSLDTQPWLADHAVLGSVLLPGTAFVEIAVRA
ORF18_pDH01    AGLRSADHPLLGASVALADAEGLLLTGRLSLDTHPWLADHAVAGTVLLPGTAFVELALRA
ORF18_pDH02    AGLGAAEHPLLGAAVELPDSDGLLLTGRLSLLSHPWLADHAVAGTVLLPGTAFVELALHA
               *:   : ****.* : *.  :.  : :.**.   ::.**.**  : :....:***:::*  :*

ORF10_pDH03    GDQVGCDVVEELTLEAPLVVPQRGGVQLQLVVEAP--SGPGQRPFSVHS
ORF11_pDH01    GDQAGCERVEALVLDAPLALPAEGAVRVQVLVEAP--DEQGRRPFTVSS
ORF12_pDH01    GDQVGCDVVEELTLEAPLVLPERGAVQIQMHVGAPDADGTGRRTFTLSS
ORF12_pDH04    GDEVGCEEVEELVLPLVLPEKGAVQLRLSVGGA--DDQGRRSVHVHS
ORF14_pDH02    GDQVGCDYLEELTLEAPLVLPEHGGVQLRVWVGAA--DESGRRPFALHS
ORF14_pDH03    GELVGCGAVEELALEAPLTLADQGAVQFQLAVDAP--DGAGRRTLTLHS
ORF15_pDH01    GDQVGCDLLEELTLHAPLVLPPAGGVQVQLWVGAP--DATGRRTLGVHS
ORF15_pDH02    GERVGTRALDELTLQAPLILPNEGAVQLQVVVGAP--DAAGHRTVAVYS
ORF15_pDH03    GDHAGCDLLEDLTLEAPLVLPEAGGVQLQLVVEAP--DASRRRVFHIYS
ORF17_pDH01    GDHTGCDLLDELTLEAPLVLPPHGGVQIQLAVGAP--DAEGRRSLTLHS
ORF17_pDH02    GDQAGCDLLEELTLEAPLILAPQAAARLQIVVGAP--DGSGRRTLDVYS
ORF17_pDH03    GDQVGCDLIDELTLEAPLVLPPHGGVQLRLAVAAA--DATGRRTLAFHS
ORF17_pDH04    GDQVGCDVLEELTLEAPLVVPERGGVQLRLTVAAA--DESGRRGLSLYS
ORF18_pDH01    GDQVGCDLIDELTLAAPLVLPEQGGVELQITVAAP--DESGRRSVAFHS
ORF18_pDH02    GQRVGSGLLEELTLEAPLVLPERGALQLRVSVAAP--DEAGRRALHVHS
               *:  .*     ::  *.* ***  :.    ..  ..:: *    .     .  :*  .  . *
```

Figure 5

```
ORF17_pER02              QLAVRRGTVHAPRLARVPAATPLTPPPGESAWRMDIEDKGTLDHLTLVPSPESAAPLEPG
AAF71776_mod05|NYST      QLALRDGGVLAARLARFDTAAALTPPAD-RAWRLDSTAKGSLNGLALTPYPAALAPLTGH
AAF71767_mod15|NYST      QAVVREGTVRVGRLARLDSGRGLVPPPG-TPWRLGSRAKGSLDGLALLPHPEARRPLTGH
                         *  .:*  *  *   .  ****.  :.    *.**..   .**:.     **:*: *:* * *  :    **

ORF17_pER02              QVRVAVRAAGLNFRDVLNALGMYPG-DPGLMGSEGAGIVVETGPGVTGLAPGDRVMGMLP
AAF71776_mod05|NYST      EVRVEVRAAGLNFRDVLNALGMYPGDDVGSFGSEAAGVVVEVGPEVTGLAPGDQVMGMIT
AAF71767_mod15|NYST      EVRVGIRAAGLNFRDVLNALGMYPG-DAGLFGSEAAGVVVEVGPEVTGLAPGDRVMGMLF
                         :*** :***************** *  *  .***.**:*** ** ********:**** ;

ORF17_pER02              GSFGPLAVVDRRMIAPMPEGWTFAEAASVPIVFMTAYYALHDLAGLQGGESLLVHAAAGG
AAF71776_mod05|NYST      GSFGSLAVDDARRLARLPEDWSETGASVPLVFLTAYYALKELGGLRAGEKVLVHAGAGG
AAF71767_mod15|NYST      GGFGPLGIADARLLTPVPADWSWETGASVPLVFLTAYYALKELGGLRAGEKVLVHAGAGG
                         *.**.*.: *  *  :: :* .*::    .****:**:******::*.**:..*: ****.***

ORF17_pER02              VGMAAVQLARHWGADVYATASPAKWDTLRGLGLGDDRIASSRTLDFEETFRTATGRGVD
AAF71776_mod05|NYST      VGMAAIQIARHVGAEVFATASEGKWDVLRSLGVADDHIASSRTLDFEAAFAEVAGDRGLD
AAF71767_mod15|NYST      VGMAAIQIARHVGAEVFATASEGKWDVLRSLGVADDHIASSRTLDFEAAFAEVAGDRGLD
                         ****:*:**  **.:*:****   .***.**.:**:***********  :*    .:*.**:*

ORF17_pER02              VVLDSLAREFVDASLRLLPRGGRFVEMGKTDVRSPQDVADAHPGVSYQAFDLTEAGLDRI
AAF71776_mod05|NYST      VVLNSLAGDFVDASMRLLGDGGRFLEMGKTDIRAADSVPD---GLSYQSFDLAWVPETI
AAF71767_mod15|NYST      VVLNALSGEFVDASMRLLGDGGRFLEMGKTDIRAADSVPD---GLSYHSFDLGMVDPEHI
                         ***:.:*:  *****:***  ****:******:*:  :..:*   *:**:.***  .  : *

ORF17_pER02              QEMLTELLTLFRSGALRPVPVSAWDLRQAPEAFRYLSQARHVGKIVLTLP
AAF71776_mod05|NYST      GTMLAELMDLFRTGALRPLPVRTWDVRHAKDAFRFMSMAKHIGKIVLTLP
AAF71767_mod15|NYST      QRMLLDLVELFDRGALAALPVRSWDVRRAGEAFRFMSLAQHIGKIVLTVP
                         .  **  :*:  ** ***   .:**  :**:*:*  ::***:*  *:*.*******:*
```

Figure 6a

```
ORF10_pKR01   PTGTVLVTGGTGVLGGRVARWLAGA-GAERLVLTSRRGLDAPGAVELVEELTTGFGVEVS
ORF10_pKR02   PTGTVLVTGGTGVLGGRVARWLAGA-GAERLVLTSRRGLDAPGTAELVEELTS-SGVEVS
ORF10_pKR03   PSGTVLVTGATGTLGGLFARHLVTAYGVRRLLLTSRRGPEAEGAAELVAELEQ-LGAHVE
ORF10_pKR04   PTGTVLVTGGTGVLGGRVARWLAGA-GAERLVLTSRRGPDAPGAAELVEELTTGFGVEVS
ORF10_pKR05   PRGTVLVTGCTGALGGHVARWLAAH-GAEHLVLLSRRGPQAPGADALVAEIAA-LGAGAT
ORF11_pKR01   PAGTVLITGGSGTLAGIVARHLATAHGVRRLLLLSRRGADAPGAGELTAELAG-LGAQVS
ORF11_pKR02   PRGTVLVTGCTGALGRHVARHLAER-GAERLVLVSRRGADAPGAAETEAELSA-FGAAVT
ORF12_pKR01   PGSTVLITGAGGMLGGLIARRLVAEHGVRHLLLVGRRGAAAPGAEQLSAELAE-AGASVT
ORF12_pKR02   PTGTVLVTGGTGVLGGRVARWLAGA-GAERLVLTSRRGPDAPGAAELVEELTTGFGVEVS
ORF12_pKR03   PTGTVLVTGCTGVLGGRVARWLAGA-GAERLVLTSRRGPDAPGAAELVEELAG-SGVEVS
ORF12_pKR04   PRGTVLITGASGGLAGLFARHLVAEHGVRHLLLVGRRGAAAEGAAQLADELVA-LGAQVT
ORF13_pKR01   PQGTVLVTGCTGALGAHVARWLAGN-GAEHLLLTSRRGPDAPGAAALRDELTA-LGTQVT
ORF14_pKR01   TTGTALITGCTGALGRHVARWLART-GAQHLLLVSRRGPEAEGADALAAELRA-LGAEVT
ORF14_pKR02   PGGTVLITGATGALGGLFARHLAAEHGVERLLLVGRRGADAPGAAELVAELAE-SGTLAT
ORF14_pKR03   ADGTVLVTGASGTLGGLFARHLATTHGARHLLLLSRRGDRAPGAGELTRELTE-AGVDVT
ORF15_pKR01   PDGTVLVTGASGTLGGLVARHLVTGRGVRRLLLLSRRGADAPGAGELAAELTG-LGAEVS
ORF15_pKR02   VDGTVLVTGASGTLGGLFARHLVVERGVRRLLLVSRRGGAAEGAAELGAELTE-LGADVR
ORF15_pKR03   PEGTVLITGASGTLGGLLARHLVTEHGVRHLLLTSRRGAAAEGATQLADELVT-LGAQVT
ORF16_pKR01   PQGTTLVTGCTGALGAHVARWLAEN-GAEHLLLTSRRGPDAPGAAALRDELTA-LGAQVT
ORF16_pKR02   PQGTTLVTGCTGALGAHVARWLAEN-GAEHLLLTSRRGPDAPGAAELRDELTA-LGAQVT
ORF17_pKR01   PDGTALVTGATGTLGGLVARHLVAAHGVRHLLLTSRRGEAAAGAAELAAGLRE-LGAEVT
ORF17_pKR02   SQGTVLITGCTGTLGAVVARHAVTTRGARRLLLTSRRGEAAAGAAELAAELRE-LGAEVT
ORF17_pKR03   VDGTVLVTGASGTLGGLFARHLVVERGVRRLLLVSRRGEAAEGAAELGAELTE-LGADVR
ORF17_pKR04   SDGTVLVTGASGTLGGLFARHLVVERGVRRLLLVSRRGGAAEGAAELGAELTE-LGADVR
ORF18_pKR01   SDGTVLVTGASGTLGGLFARHLVVERGVRRLLLVSRRGEAAEGAAELGAELTG-LGADVR
ORF18_pKR02   PDGTVLITGCTGSLGSLLARHLVVEHGVRHLLLTSRRGAAAEGAPELVAALAE-LGAEAT
              .*.*:** * * .** .   *...:*:* .*** * *:       :    *. .

ORF10_pKR01   VVACDAADRDALRALLSAEAG-----SLTAVVHTAGVLDDGVLDALTPDRIDSVVRAKAV
ORF10_pKR02   VVACDAADRDALRALLSSEAG-----SLTAVIHTAGVLDDGVLDALTPDRIDGVVRAKAV
ORF10_pKR03   LVACDAADRSALAAALLGAVPSE---HPLTAVVHTAGVLDDGILSSLTPERVAAVLRPKVD
ORF10_pKR04   VVACDAADRDALRTLLSAEAG-----TLTAVIHTAGVLDDGVLDALTPDRIDSVLRAKAV
ORF10_pKR05   AVACDVTDRTAVSELLAGLADGTYGPGLTAVFHTAGAGQFAPLDGTGPGEVAEVVAAKVA
ORF11_pKR01   WAACDAGDRDALAAVLAAVPAA---HPLTAVVHTAGVLDDGVIGSLTPERLDTVLRPKAD
ORF11_pKR02   LVACDVADRDALGTLVARLAAD--GTPVRAVVHAAGVSQ-PPGTGTDLPGFARVVAAKTA
ORF12_pKR01   WAACDVADRDALSAVLHAIPAE---HPLGAVVHTAGVLDDGVIASLTPERLSAVLRPKVD
ORF12_pKR02   IVACDAADRDALRALLSAEAG-----TLTAVIHTAGVLDDGVLDALTPDRIDSVLRAKAV
ORF12_pKR03   VVACDAADRDALRALLSAEAG-----TLTAVIHTAGVLDDGVLDALTPDRIDSVLRAKAV
ORF12_pKR04   WAACDVADRDALAALLASVPAE---QPLTAVVHTAAVLDDGVVDLLTPERVDRVLRPKAE
ORF13_pKR01   IASCDMADRDAVTALIAAIPAD---QPLTAVIHAAAVVDDGVIETLAPEQVEAVLRVKVD
ORF14_pKR01   IAACDVADRDAVAALLATLPAE---HPLTNVVHAAGVLDDGVLDAQTPQRLAGVLRPKAH
ORF14_pKR02   WAACDVADRDALAALLADIPAE---HPLTAVVHTAGVLDDGVISSLTPERLSAVLRPKVD
ORF14_pKR03   WAACDAADRDALAAVLAAIPAD---RPLTAVVHTAGVLDDGIIDSLTPERLDTVLRPKVD
ORF15_pKR01   WAACDAGDRDALAAVLAAVPAA---HPLTAVVHTAGVLDDGVIGSLTPERLDTVLRPKAD
ORF15_pKR02   WAACDVADREALESVLAGIPAE---YPLSGVVHTAGVLDDGVVSSLTAERVSAVLRPKVD
ORF15_pKR03   WAACDAADRDALAALLESVPAA---HPLTAVVHTAGVLDDGTVESLTAGRMATVLRPKVD
ORF16_pKR01   IAACDVSDRDAVAALIAAVPAD---QPLTAVVHTAAVLDDGVIEALTPEQIERVLRVKVD
ORF16_pKR02   IATCDMADRDAVAALIAAVPAD---QPLTAVMHTAGVLDDGVIDALTPERFGTVLAPKAD
ORF17_pKR01   IAACDAADRDALAALIGSVPAE---HPLTAVVHTAGVLDDGVLEALTPERIDAVLPAKVD
ORF17_pKR02   IAACDAADRDALAALIESIPSE---HPLTAVIHTAGVLDDGVVDSLTPERLSTVLRPKVD
ORF17_pKR03   WAACDVADRDALEAVLAGIPAE---YPLSGVVHTAGVLDDGVVSSLTPERLSAVLRPKVD
ORF17_pKR04   WAACDVADRDALESVLAGIPAE---YPLSGVVHTAGVLDDGVVSSLTPERLSAVLRPKVD
ORF18_pKR01   WAACDVADREALESVLAGIPAE---YPLSGVVHTAGVLDDGVVSSLTAERVSAVLRPKVD
ORF18_pKR02   VAACDAADREALAALLAGIPAA---HPLTAVVHTAGRVDDGLLASLSPERIDTVLRPKAD
              .:** ** *:  ::   .    :  *.*:*. :      . *:  *.
```

Figure 6b

```
                                                                #
ORF10_pKR01    SALNLHELTAELGIELSDFVLFSSVTGTVGAAGQANYAAANAFLDALAEQRRADGLAATS
ORF10_pKR02    SALNLHELTAELGIELSAFVLFSSMSGTVGTAGQANYAAANAYLDALAEQRRADGLAATS
ORF10_pKR03    AAWNLHELTREL--GLSAFVLFSGAAAAFGAAGQGNYAAANSFLEALAEQRRAEGLPATS
ORF10_pKR04    SAFNLHELTAELGIELSAFVLFSSMSGTVGAAGQANYAAANAYLDALAEQRRADGLAATS
ORF10_pKR05    GAAHLDELLGD--TELDAFVLFSSIAGVWGSGGQSAYAAANAHLDALAQQRRARGLTATS
ORF11_pKR01    AALHLHELTRDL--PLTAFVLFSAIAGTLGSAGQANYAAANVFLDALAQHRHDQDLPATS
ORF11_pKR02    GAVHLDALFDAP-DSLDAFVLFSSIAGVWGSGGQGAYSAANTFLDTLAERRRARGLAATA
ORF12_pKR01    AACNLHELTRHL--DLTAFVLFSSIGGVFGGPGQGNYAAANVFLDALAQHRRSQGLAATS
ORF12_pKR02    SALNLHELTAELDIELSAFVLFSSMSGTVGAAGQANYAAANAFLDALAEQRRADGLAATS
ORF12_pKR03    SAINLHELTAELGIELSAFVLFSGVTGTWGTAGQANYAAANAYLDALAEQRRADGLAATS
ORF12_pKR04    AALHLHELTKDL--DLSAFVLFSAAAGTLGGAGQANYAAANVFLDALARHRTARGLTALS
ORF13_pKR01    ATLILHELTRGL--DLSAFVLFSSFAATFGAPGQGNQAPGNAYLDAFAEYRRGSGLPATS
ORF14_pKR01    AAQVLHELTRDL--DLSAFVLFSSVAAVFGAAGQANYAAANASLEALAEQRRADGLPATV
ORF14_pKR02    AAWNLHELTRGL--DLAAFVLFSSTSGLFGGPGQGNYAAANSFLDALAQHRRAHGLPATS
ORF14_pKR03    AAWNLHELTEGH--ELSAFVLFSSVAGCFGAAGQGNYAAANTFLDALAQHRKARGLTASS
ORF15_pKR01    AALHLHELTRDL--PLTAFVLFSSAAGVFGGPGQGNYAAANSFLDALAQYRRAHGLPGRS
ORF15_pKR02    AAWNLHELTRGL--DLSLFVLFSSAAGVFGGAGQANYAAANVFLDALAQHRRAQGLAATS
ORF15_pKR03    AAWNLHELTHGL--DLAAFVLFSSAAGVFGNAGQANYAAGNTFLDALAQHRRAQGLTAVS
ORF16_pKR01    ATLHLHELTREL--DLSAFVFFSSFAATFGAPGQGNYAPGNAFLDAFAEYRRASGLPATS
ORF16_pKR02    AALTLHELTREL--GLSAFVLFSGVAGTLGDAGQGNYAAANSYLDALAEQRHADGLAATS
ORF17_pKR01    AAVHLHELTREL--DLAAFVLFSAAAGTLGGPGQANYAAANTFLDALAHRRRAEGLPATA
ORF17_pKR02    AAWNLHELTRHL--DLADFVLFSSAAGTFGGAGQANYAAANVFLDALARHRHAHGLAATS
ORF17_pKR03    AAWNLHELTRGL--DLSLFVLFSSAAGVFGGAGQANYAAANVFLDALAQHRRAQGLAATS
ORF17_pKR04    AAWNLHELTRGL--DLSFFLLFSSAAGVFGGAGQANYAAANVFLDALAQHRRAQGLAATS
ORF18_pKR01    AAWNLHELTRGL--DLSLFVLFSSAAGVFGGAGQANYAAANVFLDALAQHRRAQGLAATS
ORF18_pKR02    AALHLHELTRGL--DLAAFVLFSSAAGTLGNPGQANYAAANAFLDALAQHRRAAGLPAVS
                .:   *.  *           *   *::**.  .    * **.  :..* *:::*. *   .*..
```

```
ORF10_pKR01    IAWGPWA--EGGMAAD--EAMDARMRREGMPPMAPTSAMSALEQ
ORF10_pKR02    IAWGPWA--EGGMAAD--AALEARMRRDGVPPMPADPAIRALRQ
ORF10_pKR03    LAWGLWAPQTGGMAQQLDEVDLRRIARDGVGGLSGDEGLGLFDT
ORF10_pKR04    LAWGPWA--EGGMAGD--DAMDARMRREGLPPMAPDAALTLLRQ
ORF10_pKR05    VAWGPWG--EGGLVAD--DEAAEQLRRRGLPVMAPELSIAALQQ
ORF11_pKR01    LAWGLWA--DASGMTGGLDEAQLRRMEQHGMGTLSATDGMALFDA
ORF11_pKR02    IAWGPWA--DGGMATE--GDAEEQLSRRGLPPMDRATNLLALER
ORF12_pKR01    LAWALWA--DSTGMAGSLDEADISRMRRGGLPPLTTAEGLELFDL
ORF12_pKR02    LAWGPWA--EGGMAAD--AALEARMRRGGVPPMDAELALSALRQ
ORF12_pKR03    IAWGPWA--EGGMAAD--AALEARMRRGGVPPMKGEAAVNALQR
ORF12_pKR04    LVWGMWA-EERGMAGRLTEAELGRAGRGGVAPLSATEGLALFDA
ORF13_pKR01    IAWGPWG--SADGDDS---AAGDRMRRHGIIVMSPERTLVSLQH
ORF14_pKR01    LAWGAWA--EGGMATD--ELVAERLRLAGLPALAPELALSALHR
ORF14_pKR02    TAWGLWS-VADGMAGALDAADVNRMRRAGLPPLTAADGLGLFDT
ORF14_pKR03    LAWGLWE-TTDGMAGALDEADLTRMARSGVAALAPDEGLALFDT
ORF15_pKR01    LAWGLWE-DAEGMAGALDRADLDRMKRGGVHGLTASEGLALLDL
ORF15_pKR02    LAWGLWA--EPGGMAGALDADDVSRLGRGGVSGLSAGEGVALFDA
ORF15_pKR03    LAWGLWD-DEAGMAATLDEQDRRRLSRGSMNPLSVAEGLALFDA
ORF16_pKR01    IAWGPWG--DGGMAEG---AVGDRMRRHGVIEMSPERAVAALQH
ORF16_pKR02    VAWGRWG--DSGLAAGG--AIGERLDRGGVPAMAPRSAIRALQL
ORF17_pKR01    LAWGLWA-ERSGMTGDLADADLERISRAGVAALSSAEGLALLDT
ORF17_pKR02    LAWGLWA-EASGMTGELDTADKDRMTRSGVLGLSSEGVALLDT
ORF17_pKR03    LAWGLWA-GVGGMGGELTESDRERINRGGITALEPETGLALFDA
ORF17_pKR04    LAWGLWA--EPGGMAGALDADDVSRLGRGGVSGLSAQEGVALFDA
ORF18_pKR01    LAWGLWD-EPGGMAGALDADDVSRLGRGGVSGLSAGEGVALFDA
ORF18_pKR02    LAWGLWE-QRSAMTGALSDADVQRMARAGLAPLSSAEGLALFDT
                .*. *                         :    .:    :     :   :
```

Figure 7

```
ORF10_pAC00    SAALRDAAPDTLDPHRPFLDLGFDSLAAVDLHARLVAGTGLRLPVTLAFDHPTPAHLARHLH
ORF10_pAC01    AAVLGHDGSDAVGAERAFKELGFDSLTSVELRNRLGAATDLRLPTTLVYDYPTSAALAEYLR
ORF10_pAC02    AAVLGHAGVENVGAGRAFKELGFDSLMAVELRNRIGSATELRLPATLIYDHPTSAALAEFLR
ORF10_pAC03    AEVLGHTDARAVDADRAFKELGFDSLTAVELRNVLKAATGLRLSPTLVFDYPTPVALARHLL
ORF10_pAC04    AAVLGHGGSEAVGAERAFKELGFDSLTAVELRNRLGAATGVRLPATLIFDYPTATALAAYLR
ORF10_pAC05    AVVLGHGGATAVEAARAFKELGFDSLTAVELRNRLSTATGLRLPASLVFDYPTPAALAAHIR
ORF11_pAC01    ASVLGHASAEQVDPARAFKDLGFDSLTAVELRNRLGAATGLRLPTTLVFDHPTPTALVRHLR
ORF11_pAC02    ATALGHTSADAVAAERAFKDLGFDSLTAVELRNRLGAACGLRLPSSLVFDYPNPQALTRHLL
ORF12_pAC01    AAALGYPGPSAVEPGRSFKELGFDSLTAVELRNLLGDATGRRLPATLVFDYPTATALAGYLR
ORF12_pAC02    AEVLGHSGAEDIEAGRAFREIGFDSLTAVELRNRLGAAAELRLPATLVYDYPTPAALAVHLR
ORF12_pAC03    AAVLGHAGVESIGAARAFKELGFDSLTAVELRNRLGAVTGLRLPATLIYDYPTSGALAEYLR
ORF12_pAC04    AAVLGYGSAEHIGGEQAFKELGFDSLTAVELRNRLGAAGGLRLPATLIYDYPNPAALAQHLL
ORF13_pAC01    AAVLGHADLAAVEAGRAFKELGFDSLTSVELRNRLGAVSGLKLPASLVFDHPTPAAVAAFLR
ORF14_pAC01    AAVLGYAGPESVDPGSAFRDLGFDSLTAVEIRNLLTSRTGLRLPATLIFDYPNSLSLAAFLQ
ORF14_pAC02    AAVLGHAGPAAVESGRAFKELGFDSLTAVELRNRLNAATALRLPATLIFDYPDPTVLARYLR
ORF14_pAC03    AAVLGYAGPDDVDAARGFLDLGFDSLTAVDLRNRLTASAGLRLPVTLIFDYPSPTALAAYLA
ORF15_pAC01    ADVLGHGSPDAIDPEQAFSELGFDSLTAVELRNRLGAAIGRRLPATLIFDHPASLTLARHLS
ORF15_pAC02    AAVLGYASPEAVEKDSSFRELGFDSLTAVELRNLLGAATGLRLPATLVFDYPTSAVLADHLR
ORF15_pAC03    AQVLGHSGAAAIEPGSAFKELGFDSLTAVELRNRLGAVTGLRLPATLIFDYPTPEALSGHLR
ORF16_pAC01    AAVLGYAGPDAVEAGRAFKELGFDSLTSVELRNRLNAASGLKLPPTLVFDHPTPTVLARHLR
ORF16_pAC02    ATALGHPTTDEVGAGRAFKELGFDSLIALELRNRLNAATGLRLPATLVFDHPTPTILAEFLR
ORF17_pAC01    AAVLGYPGPEAVDPGRAFKELGFDSLTAVELRNRLGSATGVRLPATLVFDYPTPNALSAFLR
ORF17_pAC02    AAVLGHATPDAVEPTRAFKDLGFDSLTAVEFRNRLGATAGIRLPATLVFDYPTPTVLAGYLK
ORF17_pAC03    AAVLGHASTDEVPADRAFKELGFDSLTSVELRNRLGATTGERLSATLVFDYPTPHALAEFLR
ORF17_pAC04    AAVLGFAGPEAVDPARSFSEVGFDSLTAVELRNRLGAATGVRLPATLVFDYPTPDALVEYLR
ORF18_pAC01    AAVLGLAGPEAVDPARSFSEVGFDSLTAVELRNRLGAATGVRLPATLVFDYPTSLALADFLG
ORF18_pAC02    AAVLAYPSPDAVGESQEFLELGLDSLTAVELRNQLNAATGLRLPATLLFDHPTPALVAERLR
               : .*      :     *  ::*:**:* :::::  :       :*. :* :*:*  .  :   :
```

Figure 8

```
ORF18_pTE02      ---RGDTRPGLVCFSSILSISG-----PHQ------YARFASAFRGRRDVHALGAPG--F
AAF71777|NYST    MTTSTEESLWARCFHPAPAAPVRLFCFPHAGGSASFYFPVSAQLSSVAEVFAIQYPGRQD
                    :       **  . :  .     **       *    .::  : .    :*.*:   **

ORF18_pTE02      LRGEQLPSATDAVIEAQAEAVLRHADGAPFVLLGHSSGGMLAHAVAGRLESEG-------
AAF71777|NYST    RRKEAGVSDLATLADQVYDALRPLLKERPSTFFGHSMGATLAFEVARRFEADDGDLVRLF
                  * *    *      ::  :     :*:       *  .::***  *. **. ** *:*::.

ORF18_pTE02      ----VFPQALVMIDIYSHDDDAIIGIQPGLSEGMDERQDTYVPVDDNRLLAMGAYFRLFG
AAF71777|NYST    ASGRRAPSRVREEAVHRRSDDGIVEELK-LLAGTNTALLGDEEILRMILPAIRSDYQAIE
                      *. :    ::  :.**.*:    * *:  .        :    * *: : :: :

ORF18_pTE02      GWK--PEVVKTPTLLVRAGERFFDWTRSTDGDWRSYWDLDHTALDVPGNHFTMMEEHAPT
AAF71777|NYST    TYRCPPDVTVRAPLTVLTGDRDPKTSLDEAEAWRGHTTGDFDLKVLPGGHF-FVSSEAPA
                  ::   *:*.   ..* * *:*:*    .  :  .     **.:    *.      :*.:*  :::...**:

ORF18_pTE02      TAQAVEGWLDTTG
AAF71777|NYST    IIDLLRAHLAGNG
                  : :..  *  .*
```

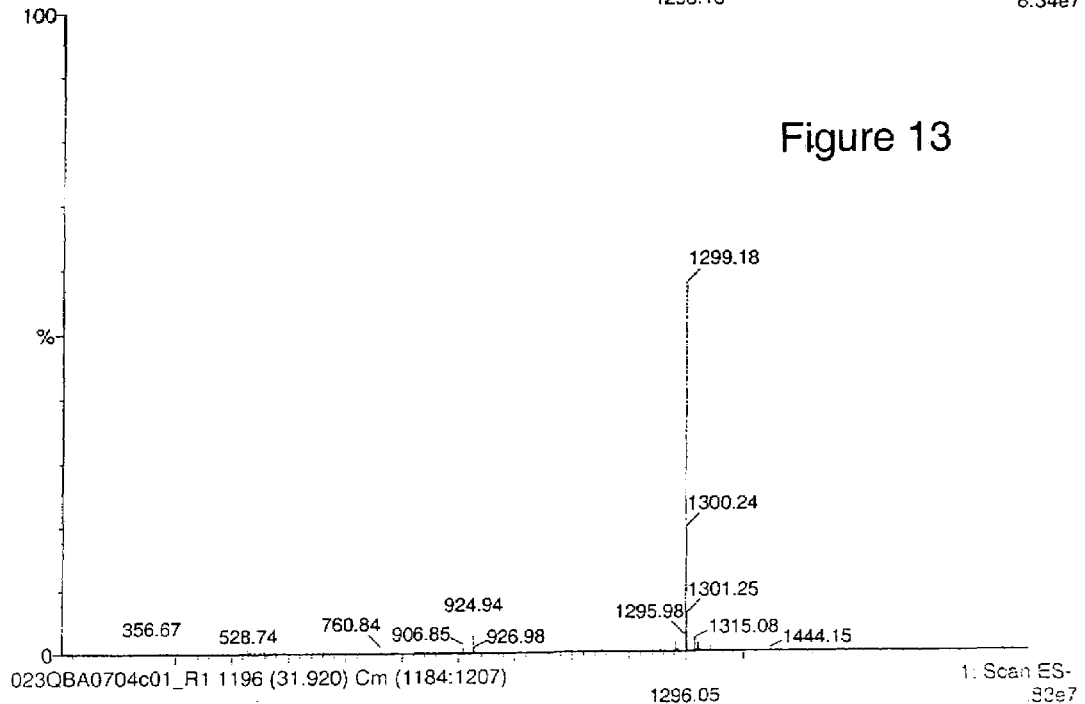
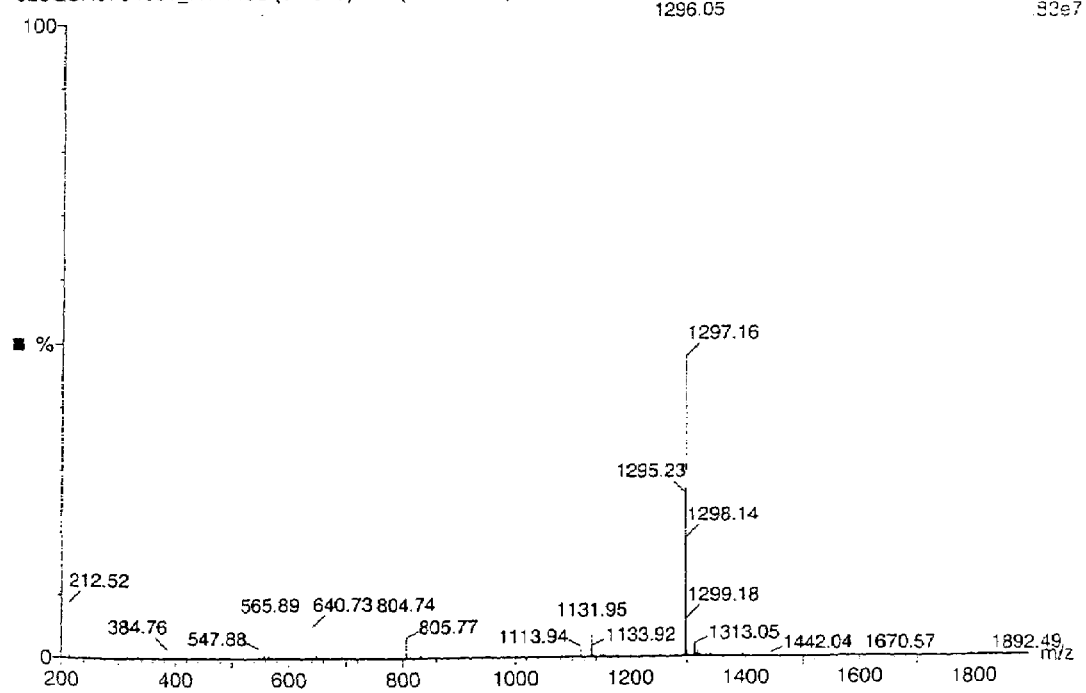
Figure 13

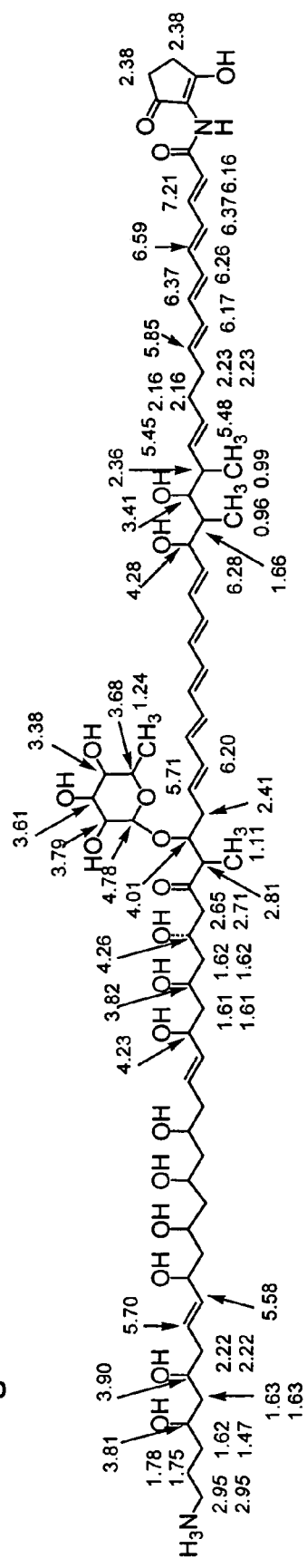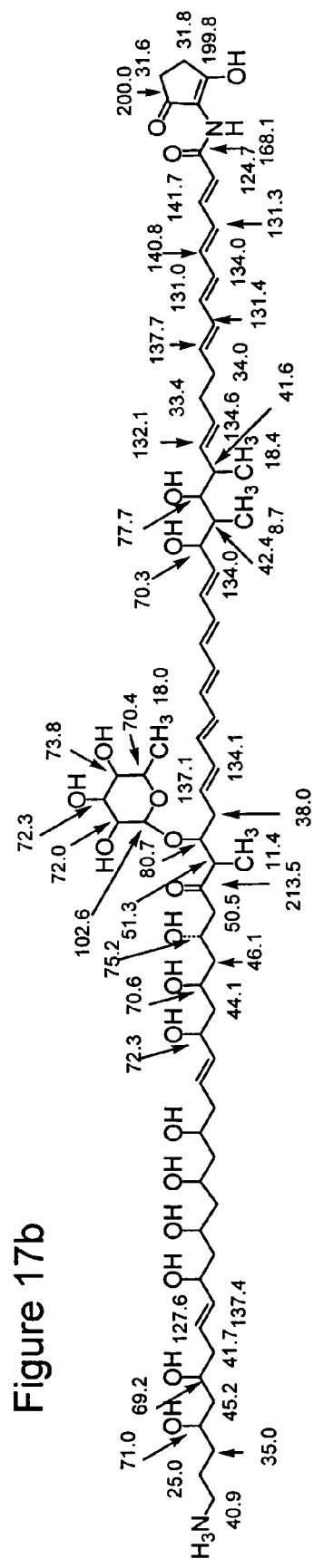
Figure 17a
Figure 17b

POLYENE POLYKETIDES, PROCESSES FOR THEIR PRODUCTION AND THEIR USE AS A PHARMACEUTICAL

RELATED APPLICATIONS

This application claims priority to U.S. Provisional Application 60/441,123 filed Jan. 21, 2003; U.S. Provisional Application 60/494,568 filed Aug. 13, 2003; U.S. Provisional Application 60/469,810 filed May 13, 2003; and U.S. Provisional 60/491,516 filed Aug. 1, 2003.

FIELD OF INVENTION

This invention relates to a new class of polyene polyketides, their pharmaceutically acceptable salts and derivatives, and to methods for their production. One method of obtaining these novel polyketides is by cultivation of novel strains of *Streptomyces aizunensis*; another method involves expression of the biosynthetic gene cluster of the invention in transformed host cells. The compounds may also be produced by known strains of certain bacteria. The invention also encompasses the novel strains of *Streptomyces aizunensis* which produce these compounds, as well as the gene cluster which directs the biosynthesis of these compounds. The invention also includes the use of these novel polyketides and their pharmaceutically acceptable salts and derivatives as pharmaceuticals, in particular, to their use as inhibitors of fungal and bacterial cell growth, inhibitors of cancer cell growth and for lowering serum cholesterol and other steroids. The invention also encompasses pharmaceutical compositions comprising these novel polyketides, or pharmaceutically acceptable salts or derivatives thereof.

BACKGROUND

*Actinomycetes* comprise a family of bacteria that are abundant in soil and have generated significant commercial and scientific interest as a result of the large number of therapeutically useful antibiotics, antifungals, anticancer and cholesterol-lowering agents, produced as secondary metabolites by these bacteria. Many *actinomycetes*, particularly those of the *Streptomyces* genus, have been extensively studied because of their ability to produce a notable diversity of biologically active metabolites. The intensive search for new natural products has led to the identification of new species of bacteria and the creation of improved strains.

Polyene polyketides are a group of natural products produced by *actinomycetes* that have generated significant commercial interest. For example Sakuda et al, 1996 *J. of Chem. Soc., Perkin trans.* 1, 2315-19; and Sakuda et al., *Tetrahedron Letters*, Vol 35, No.16, 2777-2789 (1995) disclose the linear polyene linearmycin A produced by a *Streptomyces* sp. Sakuda et al. report that linearmycin A has shown both antifungal and antibacterial activity. Pawlak et al. *J. of Antibiotics*, Vol. XXXIII No. 9, 989-997 disclose the polyene macrolide lienomycin produced by *Actinomyces diastatochromogenes*. Pawlak et al. report that lienomycin has shown antifungal, antibacterial and anti-tumor activity. Antifungal activity of polyene macrolides has also been correlated with hyperchlesterolemic effect (C. P. Schaffner, Polyene Microlides in Clinical Practice, in Macrolide Antibiotics: Chemistry, biology and practice, S. Omura, ed. Academic Press (1984), p. 491; C. P. Schaffner and H. W. Gordon, *Proc Natl. Acad. Sci. U.S.A.* 61, 36 (1968)).

Polyketides have carbon chain backbones formed of two-carbon units through a series of condensations reactions and subsequent modifications. Type I polyketides are synthesized in nature by modular polyketide synthase (PKS) enzymes having a set of separate catalytic active sites for each cycle of carbon chain elongation and modification. Because of the multimodular nature of PKS proteins, much is known of the specificity and mechanism of the biosynthesis of polyketides.

Although many biologically active compounds have been identified, there remains the need to obtain novel naturally occurring compounds with enhanced properties. Current methods of obtaining such compounds include screening of natural isolates and chemical modification of existing compounds, both of which are costly and time consuming. Current screening methods are based on general biological properties of the compound, which require prior knowledge of the structure of the molecules. Methods for chemically modifying known active compounds exist, but still suffer from practical limitations as to the type of compounds obtainable.

Thus, there exists a considerable need to obtain pharmaceutically active compounds in a cost-effective manner and with high yield. The present invention solves these problems by providing improved strains of *Streptomyces aizunensis* capable of producing potent new therapeutic compounds, as well as reagents (e.g. polynucleotides, vectors comprising the polynucleotides and host cells comprising the vectors) and methods to generate novel compounds by de novo biosynthesis rather than by chemical synthesis.

SUMMARY OF THE INVENTION

The present invention encompasses compounds of Formula I:

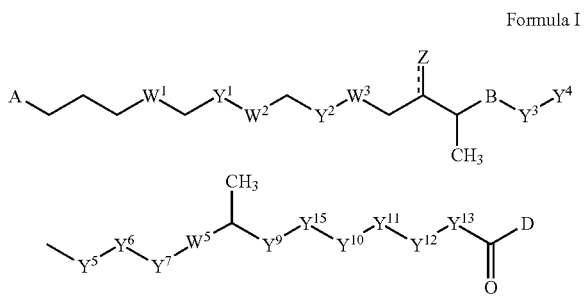

Formula I and pharmaceutically acceptable salts thereof; wherein,

A is selected from the group consisting of —NR$^1$R$^2$, —N=CR$^1$R$^2$,

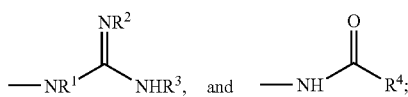

R$^1$, R$^2$, R$^3$ and R$^4$ are each independently selected from the group consisting of H, C$_{1-6}$ alkyl, C$_{2-6}$ alkenyl, C$_{3-6}$ cycloalkyl, C$_{2-6}$ heterocycloalkyl, aryl, heteroaryl and amino acid, wherein said alkyl, alkenyl, aryl and heteroaryl are optionally substituted with a group selected from halogen, OH, NO$_2$, NH$_2$ or aryl, said aryl being optionally further substituted with one or more groups independently selected from halogen, OH, NO$_2$ or NH$_2$;

B is selected from ethene-1,2-diyl or

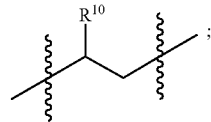

wherein R$^{10}$ is oxo or OR$^{11}$;
  wherein R$^{11}$ is H or a heterocycloalkyl, the heterocycloalkyl being optionally substituted with 1-4 substituents selected from OX, C$_{1-3}$ alkyl and —O—C(O)R$^1$, wherein X is H or, when there are at least two neighboring substituent groups that are OX, then the X can be a bond such that the two neighboring oxygen groups form a five-membered acetal ring of the formula:

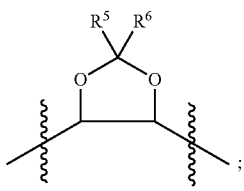

wherein R$^5$ and R$^6$ are each independently selected from the group consisting of H, C$_{1-6}$ alkyl, and C$_{2-7}$ alkenyl;

D is selected from

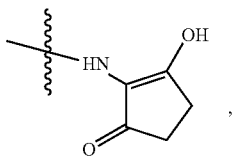

—NR$^{12a}$R$^{12a}$, and OR$^{12}$, wherein
  R$^{12}$ is selected from H and C$_{1-6}$ alkyl optionally substituted with 1 to 2 phenyl groups, wherein the phenyl group is optionally substituted with C$_{1-6}$ alkyl or halo;
  R$^{12a}$ and R$^{12a}$ are each independently selected from H, C$_{1-6}$ alkyl, C$_{2-6}$ alkenyl, C$_{3-6}$ cycloalkyl, C$_{2-6}$ heterocycloalkyl, aryl, heteroaryl and amino acid, wherein said alkyl, alkenyl, aryl and heteroaryl are optionally substituted with a group selected from halogen, OH, NO$_2$, NH$_2$ or aryl, said aryl being optionally further substituted with one or more groups independently selected from halogen, OH, NO$_2$ or NH$_2$;

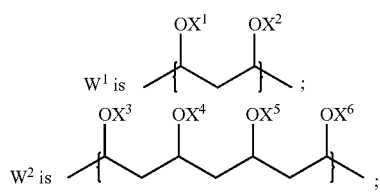

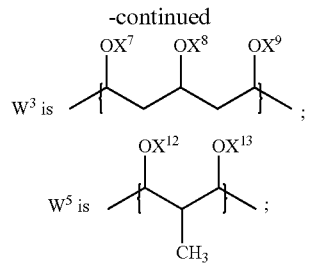

$X^1$, $X^2$, $X^3$, $X^4$, $X^5$, $X^6$, $X^7$, $X^8$, $X^9$, $X^{12}$ and $X^{13}$ are each independently selected from H, —C(O)—R$^7$ and a bond such that when any of two neighboring $X^1$, $X^2$, $X^3$, $X^4$, $X^5$, $X^6$, $X^7$, $X^8$, $X^9$, $X^{12}$ and $X^{13}$ is a bond then the two neighboring oxygen atoms and their attached carbon atoms together form a six-membered acetal ring of the formula:

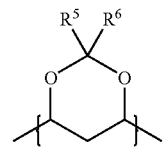

R$^5$, R$^6$ and R$^7$ are each independently selected from H, C$_{1-6}$ alkyl, C$_{2-7}$ alkenyl;

$Y^1$, $Y^2$, $Y^3$, $Y^4$, $Y^5$, $Y^6$, $Y^7$, $Y^9$, $Y^{10}$, $Y^{11}$, $Y^{12}$, $Y^{13}$ and $Y^{15}$ are each independently selected from the group consisting of ethene-1,2-diyl, ethane-1,2-diyl and

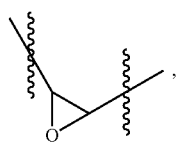

wherein said ethene-1,2-diyl and ethane-1,2-diyl groups are optionally substituted with a methyl group;

Z is selected from OH, NHR$^8$,

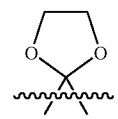

and when the dotted line is a bond then Z is oxo, or NR$^9$;
R$^8$ is selected from H, C$_{1-6}$ alkyl, C$_{2-6}$ alkenyl;
R$^9$ is C$_{1-6}$ alkyl optionally substituted with aryl.

The invention is also directed to the Compound 2(a), a linear glycosylated polyketide with an amidohydroxycyclopentenone component, and pharmaceutically acceptable salts thereof:

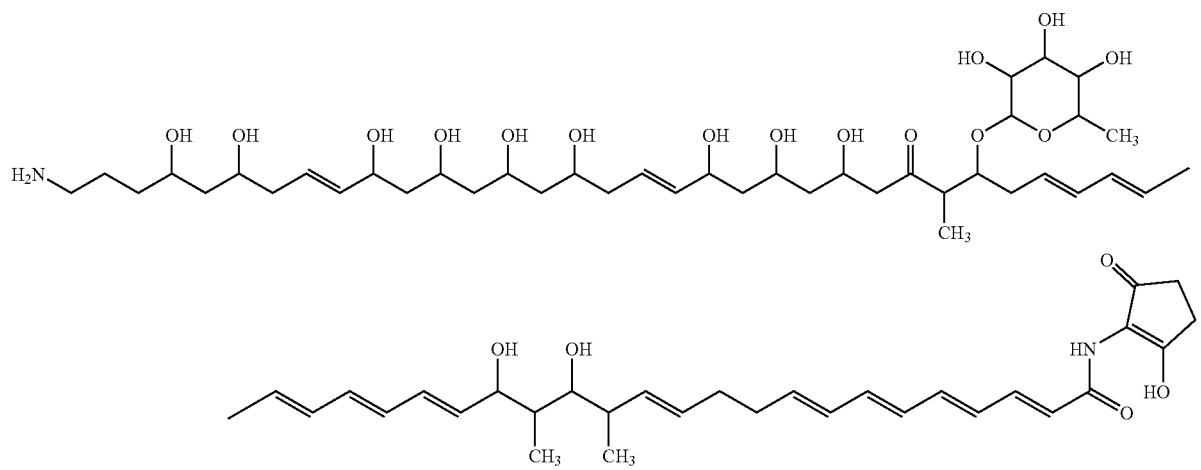

Compound 2(a)

The systematic name for Compound 2(a) has been determined to be: 56-Amino-15,17,33,35,37,41,43,45,47,51,53-undecahydroxy-14,16,30-trimethyl-31-oxo-29-(3,4,5-trihydroxy-6-methyl-tetrahydro-pyran-2-yloxy)-hexapentaconta-2,4,6,8,12,18,20,22,24,26,38,48-dodecaenoic acid (2-hydroxy-5-oxo-cyclopent-1-enyl)-amide.

The invention encompasses pharmaceutical compositions of compounds of Formula I comprising, a therapeutically effective amount of the compound of Formula I or a pharmaceutically acceptable salt thereof, and a pharmaceutically acceptable carrier. In particular, the invention is directed to pharmaceutical compositions of compound 2(a) comprising, a therapeutically effective amount of the compound 2(a) or a pharmaceutically acceptable salt thereof, and a pharmaceutically acceptable carrier.

The present invention is also directed to methods for producing the compound 2(a) and related compounds, including compounds of Formula I and Formula II as defined herein. Such methods comprise the steps of cultivating cells derived from a *Streptomyces aizunensis* strain, incubating said cultured cells aerobically in a growth medium for such time as is required for production of the desired compound, extracting said medium with a solvent such as methanol or ethanol and purifying the compound from the crude extract. The *Streptomyces aizunensis* strain which may be used in the methods of the invention may be NRRL B-11277 or a mutant thereof. A preferred strain of *Streptomyces aizunensis* useful in the methods of the invention is a mutant strain identified as [C03]023 (deposit accession number IDAC 070803-1); a most preferred strain of *Streptomyces aizunensis* useful in the methods of the invention is a mutant strain identified as [C03U03]023 (deposit accession number IDAC 231203-02). The invention also encompasses the *Streptomyces aizunensis* strains identified by deposit accession numbers IDAC 070803-1 and IDAC 231203-02.

The invention also includes methods of inhibiting fungal cell growth, which comprise contacting a fungal cell with a compound of Formula I, a compound of Formula II or compound 2(a), or a pharmaceutically acceptable salt thereof. In addition, the invention encompasses methods for treating a fungal infection in a mammal, which comprise administering to a mammal suffering from such an infection, a therapeutically effective amount of a compound of Formula I, a compound of Formula II or compound 2(a), or a pharmaceutically acceptable salt thereof. The methods of the invention are particularly useful for treating fungal infections or inhibiting the growth of fungal cells in mammals caused by *Candida albicans*. The invention also encompasses methods for treating or inhibiting other types of fungal infections in a subject, wherein said fungal infections include those caused by *Candida* sp. such as *C. glabrata, C. lusitaniae C. parapsilosis, C. krusei, C. tropicalis, S. cerevisiae; Aspergillus* sp. such as *A. fumigatus, A. niger, A. terreus, A. flavus; Fusarium* spp.; *Scedosporium* spp.; *Cryptococcus* spp.; *Mucor* ssp.; *Histoplasma* spp.; *Trichosporon* spp.; and *Blaspomyces* spp. Such methods comprise administering to a subject suffering from the fungal infection, a therapeutically effective amount of a compound of Formula I, Formula II or compound 2(a), or a pharmaceutically acceptable salt thereof.

The invention also provides methods of inhibiting cancer cell growth, which comprise contacting said cancer cell with a compound of Formula I, Formula II or compound 2(a), or a pharmaceutically acceptable salt thereof. The invention further encompasses methods for treating cancer in a subject, comprising administering to said subject suffering from said cancer, a therapeutically effective amount of a compound of Formula I, Formula II or compound 2(a) or a pharmaceutically acceptable salt thereof. Examples of cancers that may be treated or inhibited according to the methods of the invention include leukemia, non-small cell lung cancer, colon cancer, CNS cancer, melanoma, ovarian cancer, renal cancer, prostate cancer and breast cancer.

The present invention also provides the biosynthetic locus from *Streptomyces aizunensis* (NRRL B-11277) which biosynthetic locus is responsible for producing the compound of Formula 2(a). *Streptomyces aizunensis* was not previously reported to produce Compound 2(a). We have now discovered, in the *Streptomyces aizunensis* genome, the gene cluster responsible for the production of the Compound 2(a). Thus the invention provides polynucleotides and polypeptides useful in the production and engineering of compounds of Formula I and Compound 2(a). The invention also provides chemical modifications of compounds of Formula I and Compound 2(a).

In one aspect, the invention relates to the biosynthetic locus for production of a polyketide of Formula I and provides, in one embodiment, an isolated, purified or enriched nucleic acid for production of a polyketide of Formula I comprising a nucleic acid encoding at least one domain of the polyketide synthase system formed by the polyketide synthases of SEQ ID NOS: 21, 23, 25, 27, 29, 31, 33, 35 and 37.

In a further embodiment, the nucleic acid encodes one or more domains of the polyketide synthase of SEQ ID NO: 21 and comprises a nucleic acid selected from the group consisting of: a) SEQ ID NO: 22; b) the nucleic acid of residues 169-354 of SEQ ID NO: 22, the nucleic acid of residues 421-1698 of SEQ ID NO: 22, the nucleic acid of residues 1789-3093 of SEQ ID NO: 22, the nucleic acid of residues 3910-4551 of SEQ ID NO: 22, the nucleic acid of residues 4807-4992 of SEQ ID NO: 22, the nucleic acid of residues 5068-6354 of SEQ ID NO: 22, the nucleic acid of residues 6403-7686 of SEQ ID NO: 22, the nucleic acid of residues 8497-9135 of SEQ ID NO: 22, the nucleic acid of residues 9388-9573 of SEQ ID NO: 22, the nucleic acid of residues 9643-10920 of SEQ ID NO: 22, the nucleic acid of residues 10978-12267 of SEQ ID NO: 22, the nucleic acid of residues 12304-12624 of SEQ ID NO: 22, the nucleic acid of residues 13834-14487 of SEQ ID NO: 22, the nucleic acid of residues 14731-14916 of SEQ ID NO: 22, the nucleic acid of residues 15019-16314 of SEQ ID NO: 22, the nucleic acid of residues 16378-17649 of SEQ ID NO: 22, the nucleic acid of residues 18439-19080 of SEQ ID NO: 22, the nucleic acid of residues 19330-19515 of SEQ ID NO: 22, the nucleic acid of residues 19585-20862 of SEQ ID NO: 22, the nucleic acid of residues 20935-22206 of SEQ ID NO: 22, the nucleic acid of residues 23107-23754 of SEQ ID NO: 22, the nucleic acid of residues 24004-24189 of SEQ ID NO: 22; c) a nucleic acid having at least 80% identity to a nucleic acid of a) or b); and d) a nucleic acid complementary to a nucleic acid of a), b) or c).

In another embodiment the nucleic acid encodes one or more domains of the polyketide synthase of SEQ ID NO: 23 and comprises a nucleic acid selected from the group consisting of: a) SEQ ID NO: 24; b) the nucleic acid of residues 109-1386 of SEQ ID NO: 24, the nucleic acid of residues 1477-2757 of SEQ ID NO: 24, the nucleic acid of residues 2794-3114 of SEQ ID NO: 24, the nucleic acid of residues 4231-4881 of SEQ ID NO: 24, the nucleic acid of residues 5116-5301 of SEQ ID NO: 24, the nucleic acid of residues 5380-6645 of SEQ ID NO: 24, the nucleic acid of residues 6694-7977 of SEQ ID NO: 24, the nucleic acid of residues 8878-9519 of SEQ ID NO: 24, the nucleic acid of residues 9772-9957 of SEQ ID NO: 24; c) a nucleic acid having at least 80% identity to a nucleic acid of a) or b); and d) a nucleic acid complementary to a nucleic acid of a), b) or c).

In another embodiment the nucleic acid encodes one or more domains of the polyketide synthase of SEQ ID NO: 25 and comprises a nucleic acid selected from the group consisting of: a) SEQ ID NO: 26; b) the nucleic acid of residues 106-1383 of SEQ ID NO: 26, the nucleic acid of residues 1447-2721 of SEQ ID NO: 26, the nucleic acid of residues 2755-3081 of SEQ ID NO: 26, the nucleic acid of residues 4315-4965 of SEQ ID NO: 26, the nucleic acid of residues 5206-5391 of SEQ ID NO: 26, the nucleic acid of residues 5491-6768 of SEQ ID NO: 26, the nucleic acid of residues 6841-8142 of SEQ ID NO: 26, the nucleic acid of residues 8941-9582 of SEQ ID NO: 26, the nucleic acid of residues 9832-10017 of SEQ ID NO: 26, the nucleic acid of residues 10081-11358 of SEQ ID NO: 26, the nucleic acid of residues 11407-12675 of SEQ ID NO: 26, the nucleic acid of residues 13480-14118 of SEQ ID NO: 26, the nucleic acid of residues 14383-14568 of SEQ ID NO: 26, the nucleic acid of residues 14638-15912 of SEQ ID NO: 26, the nucleic acid of residues 15967-17244 of SEQ ID NO: 26, the nucleic acid of residues 17278-17598 of SEQ ID NO: 26, the nucleic acid of residues 18880-19530 of SEQ ID NO: 26, the nucleic acid of residues 19795-19980 of SEQ ID NO: 26; c) a nucleic acid having at least 80% identity to a nucleic acid of a) or b); and d) a nucleic acid complementary to a nucleic acid of a), b) or c).

In another embodiment the nucleic acid encodes one or more domains of the polyketide synthase of SEQ ID NO: 27 and comprises a nucleic acid selected from the group consisting of: a) SEQ ID NO: 28; b) the nucleic acid of residues 103-1380 of SEQ ID NO: 28, the nucleic acid of residues 1450-2760 of SEQ ID NO: 28, the nucleic acid of residues 3583-4218 of SEQ ID NO: 28, the nucleic acid of residues 4468-4653 of SEQ ID NO: 28; c) a nucleic acid having at least 80% identity to a nucleic acid of a) or b); and d) a nucleic acid complementary to a nucleic acid of a), b) or c).

In another embodiment the nucleic acid encodes one or more domains of the polyketide synthase of SEQ ID NO: 29 and comprises a nucleic acid selected from the group consisting of: a) SEQ ID NO: 30; b) the nucleic acid of residues 103-1380 of SEQ ID NO: 30, the nucleic acid of residues 1459-2754 of SEQ ID NO: 30, the nucleic acid of residues 3655-4293 of SEQ ID NO: 30, the nucleic acid of residues 4540-4725 of SEQ ID NO: 30, the nucleic acid of residues 4804-6081 of SEQ ID NO: 30, the nucleic acid of residues 6136-7419 of SEQ ID NO: 30, the nucleic acid of residues 7456-7776 of SEQ ID NO: 30, the nucleic acid of residues 8938-9588 of SEQ ID NO: 30, the nucleic acid of residues 9832-10017 of SEQ ID NO: 30, the nucleic acid of residues 10087-11364 of SEQ ID NO: 30, the nucleic acid of residues 11428-12711 of SEQ ID NO: 30, the nucleic acid of residues 12745-13065 of SEQ ID NO: 30, the nucleic acid of residues 14278-14928 of SEQ ID NO: 30, the nucleic acid of residues 15187-15372 of SEQ ID NO: 30; c) a nucleic acid having at least 80% identity to a nucleic acid of a) or b); and d) a nucleic acid complementary to a nucleic acid of a), b) or c).

In another embodiment the nucleic acid encodes one or more domains of the polyketide synthase of SEQ ID NO: 31 and comprises a nucleic acid selected from the group consisting of: a) SEQ ID NO: 32; b) the nucleic acid of residues 103-1380 of SEQ ID NO: 32, the nucleic acid of residues 1438-2742 of SEQ ID NO: 32, the nucleic acid of residues 2776-3096 of SEQ ID NO: 32, the nucleic acid of residues 4267-4917 of SEQ ID NO: 32, the nucleic acid of residues 5209-5394 of SEQ ID NO: 32, the nucleic acid of residues 5464-6741 of SEQ ID NO: 32, the nucleic acid of residues 6787-8070 of SEQ ID NO: 32, the nucleic acid of residues 8107-8427 of SEQ ID NO: 32, the nucleic acid of residues 9562-10212 of SEQ ID NO: 32, the nucleic acid of residues 10447-10632 of SEQ ID NO: 32, the nucleic acid of residues 10702-11979 of SEQ ID NO: 32, the nucleic acid of residues 12049-13326 of SEQ ID NO: 32, the nucleic acid of residues 13366-13686 of SEQ ID NO: 32, the nucleic acid of residues 14932-15582 of SEQ ID NO: 32, the nucleic acid of residues 15853-16038 of SEQ ID NO: 32; c) a nucleic acid having at least 80% identity to a nucleic acid of a) or b); and d) a nucleic acid complementary to a nucleic acid of a), b) or c).

In another embodiment the nucleic acid encodes one or more domains of the polyketide synthase of SEQ ID NO: 33 and comprises a nucleic acid selected from the group consisting of: a) SEQ ID NO: 34; b) the nucleic acid of residues 103-1380 of SEQ ID NO: 34, the nucleic acid of residues 1441-2751 of SEQ ID NO: 34, the nucleic acid of residues 3613-4248 of SEQ ID NO: 34, the nucleic acid of residues 4498-4683 of SEQ ID NO: 34, the nucleic acid of residues 4753-6030 of SEQ ID NO: 34, the nucleic acid of residues 6199-7515 of SEQ ID NO: 34, the nucleic acid of residues 8356-8994 of SEQ ID NO: 34, the nucleic acid of residues 9247-9432 of SEQ ID NO: 34; c) a nucleic acid having at least 80% identity to a nucleic acid of a) or b); and d) a nucleic acid complementary to a nucleic acid of a), b) or c).

In another embodiment the nucleic acid encodes one or more domains of the polyketide synthase of SEQ ID NO: 35 and comprises a nucleic acid selected from the group consisting of: a) SEQ ID NO: 36; b) the nucleic acid of residues 118-1395 of SEQ ID NO: 36, the nucleic acid of residues 1507-2823 of SEQ ID NO: 36, the nucleic acid of residues 2860-3180 of SEQ ID NO: 36, the nucleic acid of residues 4366-5016 of SEQ ID NO: 36, the nucleic acid of residues 5251-5436 of SEQ ID NO: 36, the nucleic acid of residues 5503-6780 of SEQ ID NO: 36, the nucleic acid of residues 6841-8154 of SEQ ID NO: 36, the nucleic acid of residues 8191-8511 of SEQ ID NO: 36, the nucleic acid of residues 9562-10638 of SEQ ID NO: 36, the nucleic acid of residues 10651-11301 of SEQ ID NO: 36, the nucleic acid of residues 11536-11721 of SEQ ID NO: 36, the nucleic acid of residues 11794-13071 of SEQ ID NO: 36, the nucleic acid of residues 13117-14409 of SEQ ID NO: 36, the nucleic acid of residues 14443-14763 of SEQ ID NO: 36, the nucleic acid of residues 15898-16548 of SEQ ID NO: 36, the nucleic acid of residues 16789-16974 of SEQ ID NO: 36, the nucleic acid of residues 17056-18333 of SEQ ID NO: 36, the nucleic acid of residues 18391-19671 of SEQ ID NO: 36, the nucleic acid of residues 19714-20034 of SEQ ID NO: 36, the nucleic acid of residues 21184-21834 of SEQ ID NO: 36, the nucleic acid of residues 22087-22272 of SEQ ID NO: 36; c) a nucleic acid having at least 80% identity to a nucleic acid of a) or b); and d) a nucleic acid complementary to a nucleic acid of a), b) or c).

In another embodiment the nucleic acid encodes one or more domains of the polyketide synthase of SEQ ID NO: 37 and comprises a nucleic acid selected from the group consisting of: a) SEQ ID NO: 38; b) the nucleic acid of residues 100-1377 of SEQ ID NO: 38, the nucleic acid of residues 1504-2778 of SEQ ID NO: 38, the nucleic acid of residues 2812-3132 of SEQ ID NO: 38, the nucleic acid of residues 4258-4908 of SEQ ID NO: 38, the nucleic acid of residues 5143-5328 of SEQ ID NO: 38, the nucleic acid of residues 5395-6672 of SEQ ID NO: 38, the nucleic acid of residues 6739-8019 of SEQ ID NO: 38, the nucleic acid of residues 8056-8376 of SEQ ID NO: 38, the nucleic acid of residues 9607-10257 of SEQ ID NO: 38, the nucleic acid of residues 10537-10722 of SEQ ID NO: 38, the nucleic acid of residues 10945-11616 of SEQ ID NO: 38; c) a nucleic acid having at least 80% identical to a nucleic acid of a) or b); and d) a nucleic acid complementary to a nucleic acid of a), b) or c).

The invention also provides nucleic acids involved in the biosynthesis of a polyketide of Formula I other than those encoding a domain of the polyketide synthase system. In this embodiment, the invention provides an isolated, purified or enriched nucleic acid selected from the group consisting of: a) a nucleic acid of SEQ ID NOS: 3, 5, 7, 9, 11, 13, 15, 17, 20, 40, 42, 44, 46, 48, 50, 52, 54, 56, 58, 60, 62, 64, 66, 68, 70, 72, 74, 76 and 78; b) a nucleic acid encoding a polypeptide of SEQ ID NOS: 2, 4, 6, 8, 10, 12, 14, 16, 19, 39, 41, 43, 45, 47, 49, 51, 53, 55, 57, 59, 61, 63, 65, 67, 71, 73, 75 and 77; c) a nucleic acid having at least 75% identity to a nucleic acid of (a) or (b); and d) a nucleic acid complementary to a nucleic acid of (a), (b) or (c).

The invention further provides a nucleic acid that is hybridizable under stringent conditions to any one of the above nucleic acids and is substitutable for the nucleic acid to which it specifically hybridizes to direct the synthesis of a compound of Formula I. The invention further provides an isolated, purified or enriched nucleic acid comprising the sequence of at least two, preferably three, more preferably five, still more preferably 7 or more of the above nucleic acids.

The invention further provides an expression vector comprising any of the above nucleic acids. The invention further provides a host cell transformed with such an expression vector.

In a further aspect, the invention provides a gene cluster for production of a polyketide of Formula I. In one embodiment, the gene cluster may comprise at least ten, preferably twelve, more preferably fifteen, still more preferably twenty or more of the above nucleic acids. In a further embodiment, the gene cluster may include the nucleic acids of a cosmid selected from the cosmids deposited under IDAC accession nos. 250203-01, 250203-02, 250203-03, 250203-04, and 250203-05. In a further embodiment, the deposited cosmids are inserted into a prokaryotic host for expressing a product. The host may be *E. coli, Streptomyces lividans, Streptomyces griseofuscus, Streptomyces ambofaciens*, another species of *Actinomycetes*, or bacteria of the genus *Bacillus, Corynebacteria*, or *Thermoactinomyces*. In a further embodiment, the invention provides a nucleic acid which hybridizes under stringent hybridization conditions to the nucleic acids of the deposited cosmids and which encodes at least one protein involved in the biosynthesis of a polyene polyketide. In a further embodiment, the invention provides the isolated gene cluster from *Streptomyces aizunensis* encoding the biosynthetic pathway for the formation of compound 2(a), wherein said isolated gene cluster is the gene cluster formed by the deposited cosmids.

In another aspect, the invention relates to an isolated polypeptide for production of a polyketide of Formula 1, and provides, in one embodiment, an amino acid sequence of a polyketide synthase domain of SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35 and SEQ ID NO: 37. The domain may be a β-ketoacyl synthase (KS) domain, an acyl carrier protein (ACP) domain, an acyl transferase (AT) domain, a ketoreductase (KR) domain, an enoyl reductase (ER) domain, a thioesterase (TE) domain or a dehydratase (DH) domain. In one embodiment, the domain is a KS domain and the amino acid comprises a sequence selected from the group consisting of the amino acid of residues 141 to 566 of SEQ ID NO: 21, residues 1690 to 2118 of SEQ ID NO: 21, residues 3215 to 3640 of SEQ ID NO: 21, residues 5007 to 5438 of SEQ ID NO: 21, residues 6529 to 6954 of SEQ ID NO: 21, residues 37 to 462 of SEQ ID NO: 23, residues 1794 to 2215 of SEQ ID NO: 23, residues 36 to 461 of SEQ ID NO: 25, residues 1831 to 2256 of SEQ ID NO: 25, residues 3361 to 3786 of SEQ ID NO: 25, residues 4880 to 5304 of SEQ ID NO: 25, residues 35 to 460 of SEQ ID NO: 27, residues 35 to 460 of SEQ ID NO: 29, residues 1602 to 2027 of SEQ ID NO: 29, residues 3363 to 3788 of SEQ ID NO: 29, residues 35 to 460 of SEQ ID NO: 31, residues 1822 to 2247 of SEQ ID NO: 31, residues 3568 to 3993 of SEQ ID NO: 31, residues 35 to 460 of SEQ ID NO: 33, residues 1585 to 2010 of SEQ ID NO: 33, residues 40 to 465 of SEQ ID NO: 35, residues 1835 to 2260 of SEQ ID NO: 35, residues 3932 to 4357 of SEQ ID NO:

35, residues 5686 to 6111 of SEQ ID NO: 35, residues 34 to 459 of SEQ ID NO: 37, residues 1799 to 2224 of SEQ ID NO: 37; and amino acid sequence having at least 75% identity to any one of the above amino acid residues.

In another embodiment, the domain is an ACP domain and the amino acid comprises a sequence selected from the group consisting of the amino acid of: residues 57 to 118 of SEQ ID NO: 21, residues 1603 to 1664 of SEQ ID NO: 21, residues 3130 to 3191 of SEQ ID NO: 21, residues 4911 to 4972 of SEQ ID NO: 21, residues 6444 to 6505 of SEQ ID NO: 21, residues 8002 to 8063 of SEQ ID NO: 21, residues 1706 to 1767 of SEQ ID NO: 23, residues 3258 to 3319 of SEQ ID NO: 23, residues 1736 to 1797 of SEQ ID NO: 25, residues 3278 to 3339 of SEQ ID NO: 25, residues 4795 to 4856 of SEQ ID NO: 25, residues 6599 to 6660 of SEQ ID NO: 25, residues 1490 to 1551 of SEQ ID NO: 27, residues 1514 to 1575 of SEQ ID NO: 29, residues 3278 to 3339 of SEQ ID NO: 29, residues 5060 to 5124 of SEQ ID NO: 29, residues 1737 to 1798 of SEQ ID NO: 31, residues 3483 to 3544 of SEQ ID NO: 31, residues 5285 to 5346 of SEQ ID NO: 31, residues 1500 to 1561 of SEQ ID NO: 33, residues 3083 to 3144 of SEQ ID NO: 33, residues 1751 to 1812 of SEQ ID NO: 35, residues 3846 to 3907 of SEQ ID NO: 35, residues 5597 to 5658 of SEQ ID NO: 35, residues 7363 to 7424 of SEQ ID NO: 35, residues 1715 to 1776 of SEQ ID NO: 37, residues 35.13 to 3574 of SEQ ID NO: 37, and an amino acid sequence having at least 75% identity to any one of the above amino acid residues.

In another embodiment, the domain is a AT domain and the amino acid comprises a sequence selected from the group consisting of the amino acid of: residues 597 to 1013 of SEQ ID NO: 21, residues 2135 to 2562 of SEQ ID NO: 21, residues 3660 to 4089 of SEQ ID NO: 21, residues 5460 to 5883 of SEQ ID NO: 21, residues 6979 to 7402 of SEQ ID NO: 21, residues 493 to 919 of SEQ ID NO: 23, residues 2232 to 2659 of SEQ ID NO: 23, residues 483 to 907 of SEQ ID NO: 25, residues 2281 to 2714 of SEQ ID NO: 25, residues 3803 to 4225 of SEQ ID NO: 25, residues 5323 to 5748 of SEQ ID NO: 25, residues 484 to 920 of SEQ ID NO: 27, residues 487 to 918 of SEQ ID NO: 29, residues 2046 to 2473 of SEQ ID NO: 29, residues 3810 to 4237 of SEQ ID NO: 29, residues 480 to 914 of SEQ ID NO: 31, residues 2263 to 2690 of SEQ ID NO: 31, residues 4017 to 4442 of SEQ ID NO: 31, residues 481 to 917 of SEQ ID NO: 33, residues 2067 to 2505 of SEQ ID NO: 33, residues 503 to 941 of SEQ ID NO: 35, residues 2281 to 2718 of SEQ ID NO: 35, residues 4373 to 4803 of SEQ ID NO: 35, residues 6131 to 6557 of SEQ ID NO: 35, residues 502 to 926 of SEQ ID NO: 37, residues 2247 to 2673 of SEQ ID NO: 37; and an amino acid sequence having at least 75% identity to any one of the above amino acid residues.

In another embodiment, the domain is a KR domain and the amino acid comprises a sequence selected from the group consisting of the amino acid of: residues 1304 to 1517 of SEQ ID NO: 21, residues 2833 to 3045 of SEQ ID NO: 21, residues 4612 to 4829 of SEQ ID NO: 21, residues 6147 to 6360 of SEQ ID NO: 21, residues 7703 to 7918 of SEQ ID NO: 21, residues 1411 to 1627 of SEQ ID NO: 23, residues 2960 to 3173 of SEQ ID NO: 23, residues 1439 to 1655 of SEQ ID NO: 25, residues 2981 to 3194 of SEQ ID NO: 25, residues 4494 to 4706 of SEQ ID NO: 25, residues 6294 to 6510 of SEQ ID NO: 25, residues 1195 to 1406 of SEQ ID NO: 27, residues 1219 to 1431 of SEQ ID NO: 29, residues 2980 to 3196 of SEQ ID NO: 29, residues 4760 to 4976 of SEQ ID NO: 29, residues 1423 to 1639 of SEQ ID NO: 31, residues 3188 to 3404 of SEQ ID NO: 31, residues 4978 to 5194 of SEQ ID NO: 31, residues 1205 to 1416 of SEQ ID NO: 33, residues 2786 to 2998 of SEQ ID NO: 33, residues 1456 to 1672 of SEQ ID NO: 35, residues 3551 to 3767 of SEQ ID NO: 35, residues 5300 to 5516 of SEQ ID NO: 35, residues 7062 to 7288 of SEQ ID NO: 35, residues 1420 to 1636 of SEQ ID NO: 37, residues 3203 to 3419 of SEQ ID NO: 37; and an amino acid sequence having at least 75% identity to any one of the above amino acid residues.

In another embodiment, the domain is a DH domain and the amino acid comprises a sequence selected from the group consisting of the amino acid of: residues 4102 to 4208 of SEQ ID NO: 21, residues 932 to 1038 of SEQ ID NO: 23, residues 919 to 1027 of SEQ ID NO: 25, residues 5761 to 5866 of SEQ ID NO: 25, residues 2486 to 2592 of SEQ ID NO: 29, residues 4249-4355 of SEQ ID NO: 29 residues 926 to 1032 of SEQ ID NO: 31, residues 2703 to 2809 of SEQ ID. NO: 31, residues 4456 to 4562 of SEQ ID NO: 31, residues 954 to 1060 of SEQ ID NO: 35, residues 2731 to 2837 of SEQ ID NO: 35, residues 4815 to 4921 of SEQ ID NO: 35, residues 6572 to 6678 of SEQ ID NO: 35, residues 938 to 1044 of SEQ ID NO: 37; residues 2686 to 2792 of SEQ ID NO: 37; and an amino acid sequence having at least 75% identity to any one of the above amino acid residues.

In another embodiment, the domain is an ER domain and the amino acid comprises a sequence selected from the group consisting of the amino acid of: residues 3188 to 3546 of SEQ ID NO: 35 and any amino acid sequence having at least 75% identity to residues 3188 to 3546 of SEQ ID NO: 35.

In another embodiment, the domain is an TE domain and the amino acid comprises a sequence selected from the group consisting of the amino acid of: residues 3649 to 3872 of SEQ ID NO: 37, and any amino acid sequence having at least 75% identity to residues 3649 to 3872 of SEQ ID NO: 37.

In another embodiment, the invention provides a polypeptide involved in the biosynthesis of a polyketide of Formula I other than a polypeptide encoding a domain of the polyketide synthase system of the invention. In this embodiment, the invention provides an isolated polypeptide for the production of a polyketide of Formula I selected from the group consisting of: a) SEQ ID NOS: 2, 4, 6, 8, 10, 12, 14, 16, 19, 39, 41, 43, 45, 47, 49, 51, 53, 55, 57, 59, 61, 63, 65, 67, 69, 71, 73, 75 and 77; and b) a polypeptide which is at least 75% identical to SEQ ID NOS: 2, 4, 6, 8, 10, 12, 14, 16, 19, 39, 41, 43, 45, 47, 49, 51, 53, 55, 57, 59, 61, 63, 65, 67, 69, 71, 73, 75 and 77.

In another aspect, the invention provides a method of making a polypeptide having a sequence selected from the group consisting of SEQ ID NOS: 2, 4, 6, 8, 10, 12, 14, 16, 19, 21, 23, 25, 27, 29, 31, 33, 35, 37, 39, 41, 43, 45, 47, 49, 51, 53, 55, 57, 59, 61, 63, 65, 67, 69, 71, 73, 75 and 77 comprising the steps of: (a) introducing a nucleic acid encoding said polypeptide, said nucleic acid being operably linked to a promoter, into a bacterial host cell; and (b) culturing the transformed host cell under conditions which result in the expression of the polypeptide.

In another aspect the invention is drawn to a method for increasing the yield of the polyketides of the invention using the deposited cosmids of the nucleic acids described above, said method comprising the steps of transforming a prokaryotic host with cosmids or nucleic acids and culturing the transformed prokaryotic host under conditions which result in the expression of the polyketide.

BRIEF DESCRIPTION OF THE DRAWINGS

FIG. 1: Diagram of the biosynthetic locus for compound 2(a) from *Streptomyces aizunensis*. Also indicated are the positions of cosmids deposited under IIDAC accession numbers 250203-01, 250203-02, 250203-03, 250203-04 and 250203-05, which span the locus of compound 2(a).

FIG. 2a-d: Multiple amino acid alignment comparing the 26 KS domains present in the polyketide synthase (PKS) for compound 2(a) (ORFs 10 to 18). The boundaries and key residues (highlighted in black) of the KS domains were chosen as described by Kakavas et al., *J. Bacteriol.* 179, 7515-7522 (1997).

FIG. 3a-d: Multiple amino acid alignment comparing the 26 AT domains present in the compound 2(a) PKS (ORFs 10 to 18). The boundaries and key residues (highlighted in black) of the AT domains were chosen as described by Kakavas et al., supra.

FIG. 4: Multiple amino acid alignment comparing the 15 DH domains present in the compound 2(a) PKS (ORFs 10, 11, 12, 14, 15, 17 and 18). The boundaries and key residues (highlighted in black) of the DH domains were chosen as described by Kakavas et al. supra. The inactive DH domains are highlighted.

FIG. 5: Amino acid alignment comparing the ER domain present in the compound 2(a) PKS (ORF 17) with the ER domains from modules 5 and 15 in the nystatin biosynthetic locus as described by Brautaset et al., *Chem. Biol.*, 7, 395-403 (2000). The boundaries and key residues (highlighted in black) of the ER domain were chosen as described by Kakavas et al. supra.

FIGS. 6a and 6b: Multiple amino acid alignment comparing the 26 KR domains present in the compound 2(a) PKS (ORFs 10 to 18). The boundaries and key residues (highlighted in black) of the KR domains were chosen as described by Kakavas et al. supra, and Fisher et al. *Structure Fold Des.* 8, 339-347 (2000). The inactive KR domain found in ORF 13/module 12 is highlighted.

FIG. 7: Multiple amino acid alignment comparing the 27 ACP domains present in the compound 2(a) PKS (ORFs 10 to 18). The boundaries and key serine residues (highlighted in black) of the ACP domains were chosen as described by Kakavas et al. supra.

FIG. 8: Amino acid alignment comparing the TE domain present in the compound 2(a) PKS (ORF 18) with the TE domain from module 7 in the nystatin biosynthetic locus as described by Brautaset et al. supra. The boundaries and key residues (highlighted in black) of the ER domain were chosen as described by Kakavas et al. supra.

In each of the clustal alignments (FIGS. 2 to 8) a line below the alignment is used to mark strongly conserved positions. In addition, three characters, namely * (asterisk), : (colon) and . (period) are used, wherein "*" indicates positions which have a single, fully conserved residue; ":" indicates that one of the following strong groups is fully conserved: STA, NEQK, NHQK, NDEQ, QHRK, MILV, MILF, HY, and FYW; and "." indicates that one of the following weaker groups is fully conserved: CSA, ATV, SAG, STNK, STPA, SGND, SNDEQK, NDEQHK, NEQHRK, FVLIM, and HFY.

Figure 9:
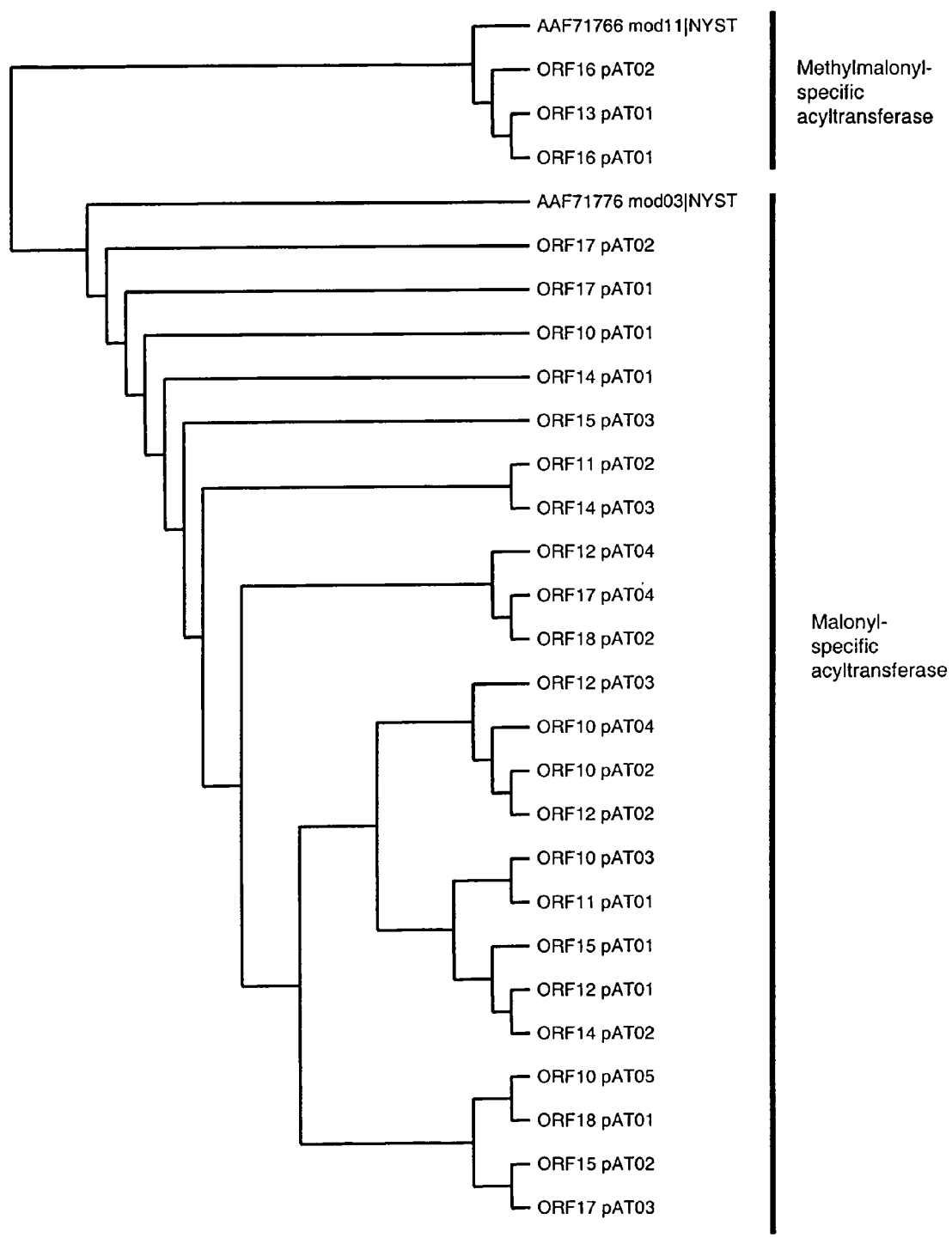

FIG. 9: Phylogenetic analysis of the 26 AT domains present in the compound 2(a) PKS (ORFs 10 to 18) along with a malonyl-specific and a methylmalonyl-specific AT domain present in modules 3 and 11 respectively of the nystatin PKS system as described by Brautaset et al. supra.

FIG. 10a to 10c: biosynthetic pathway for compound 2(a) polyketide core structure.

Figure 11:
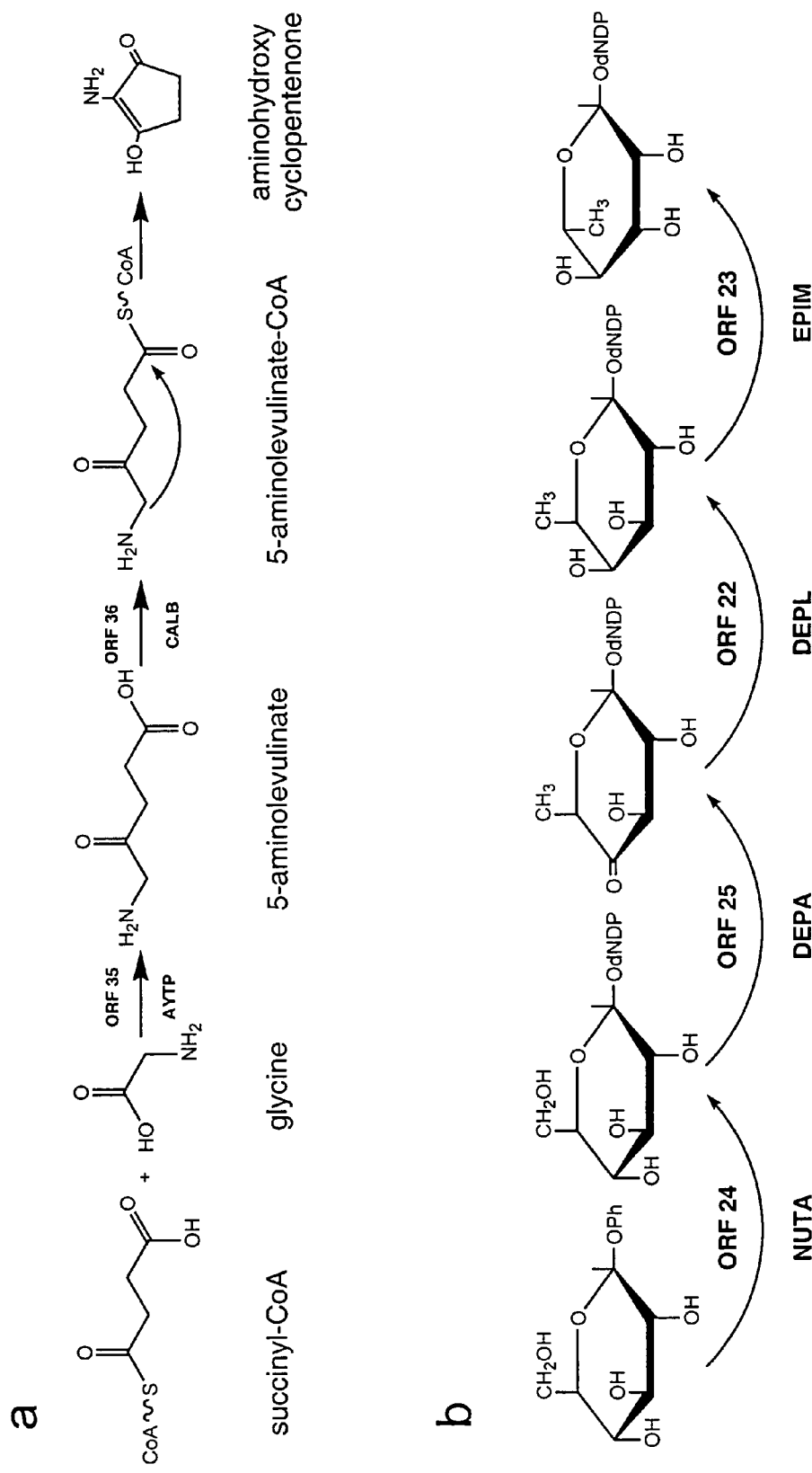

FIGS. 11a and 11b: biosynthetic pathways for compound 2(a) aminohydroxy-cyclopentenone (a) and deoxysugar (b) components.

FIGS. 12a to 12f: outline of strategies for the genetic modification of locus for compound 2(a) providing for variants that functionally modify compound 2(a).

FIG. 13: shows the data for the compound of compound 2(a) obtained by electrospray mass spectrometry.

Figure 14:
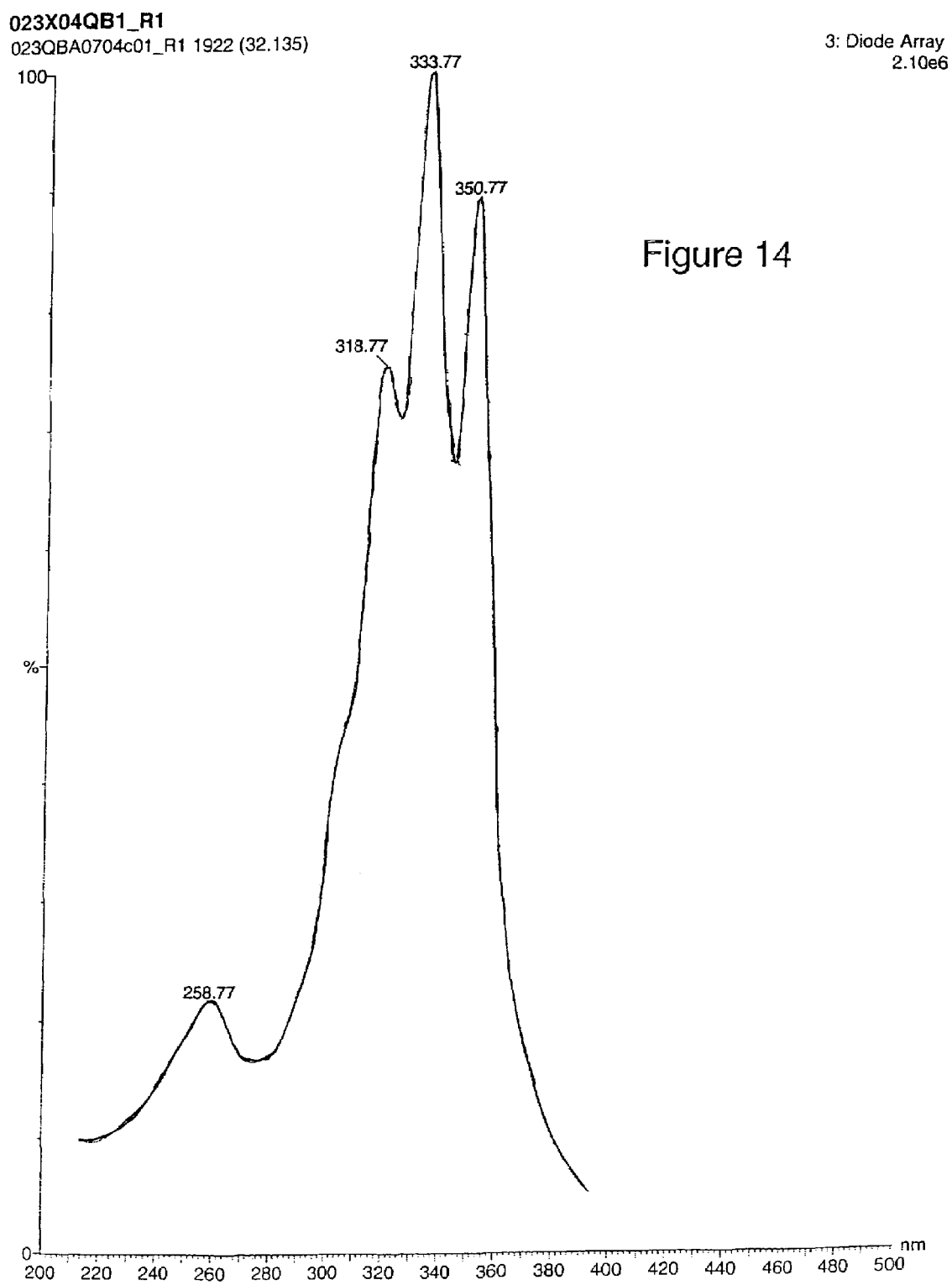
Figure 15A:
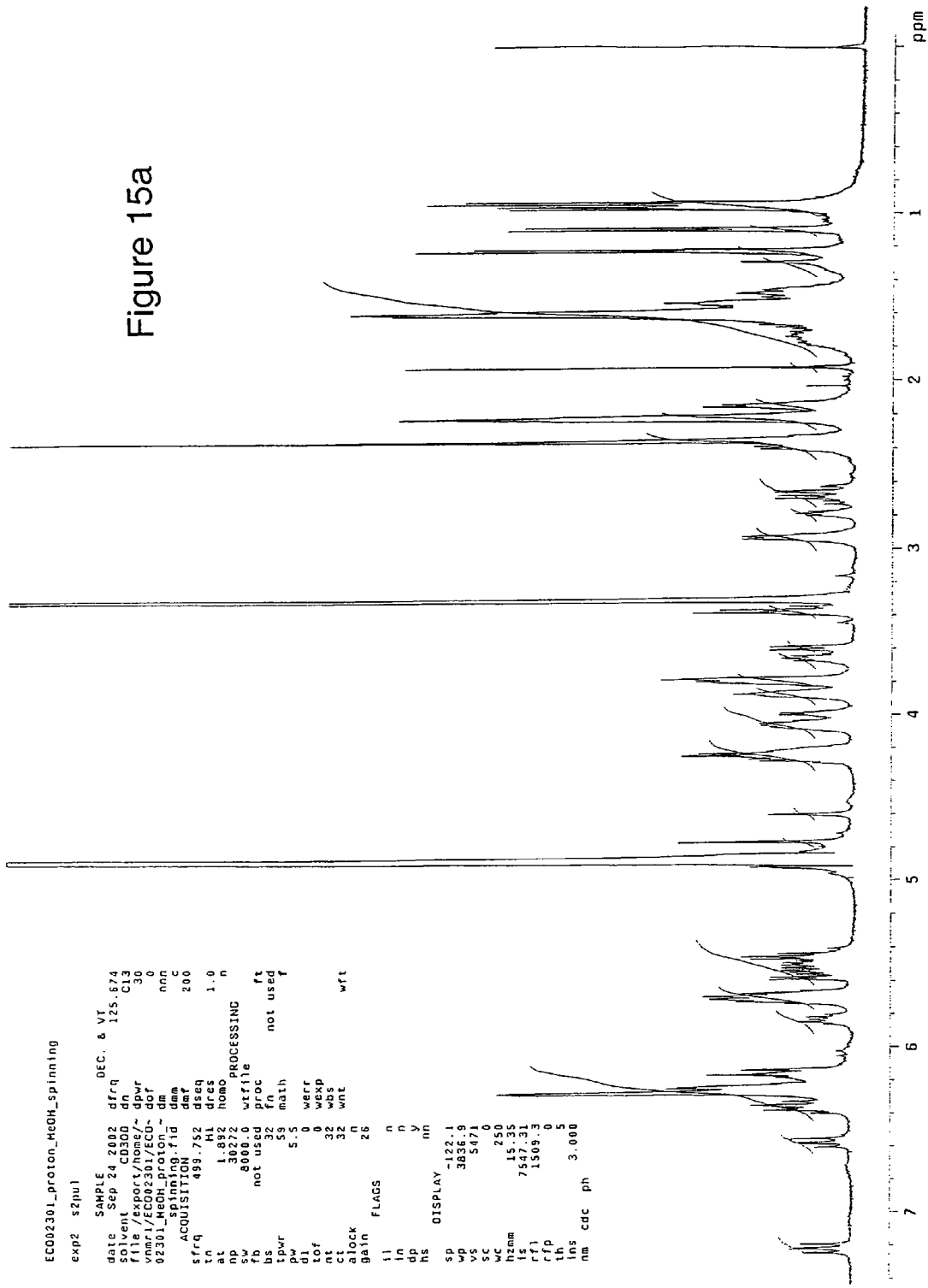
Figure 15B:
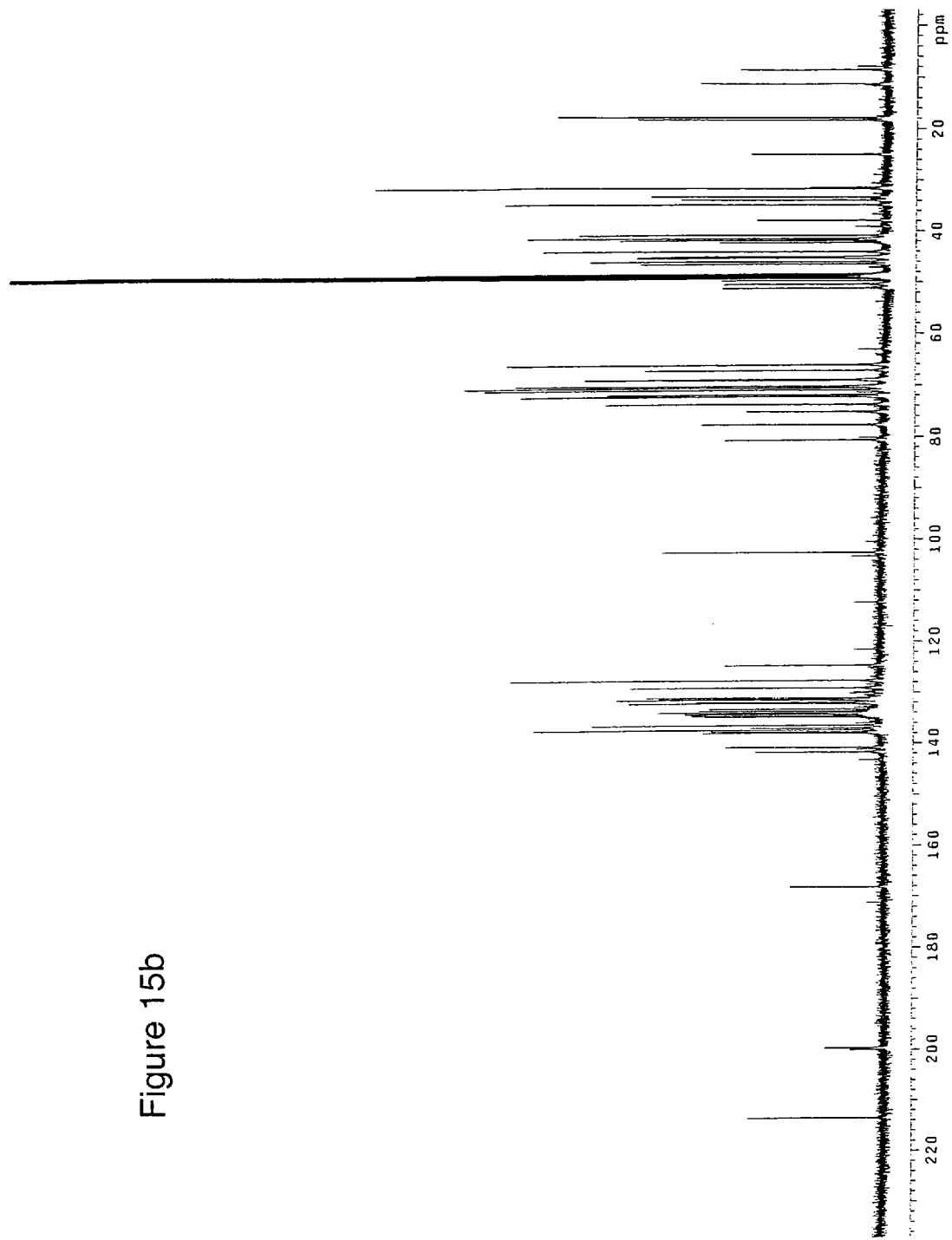
Figure 15C:
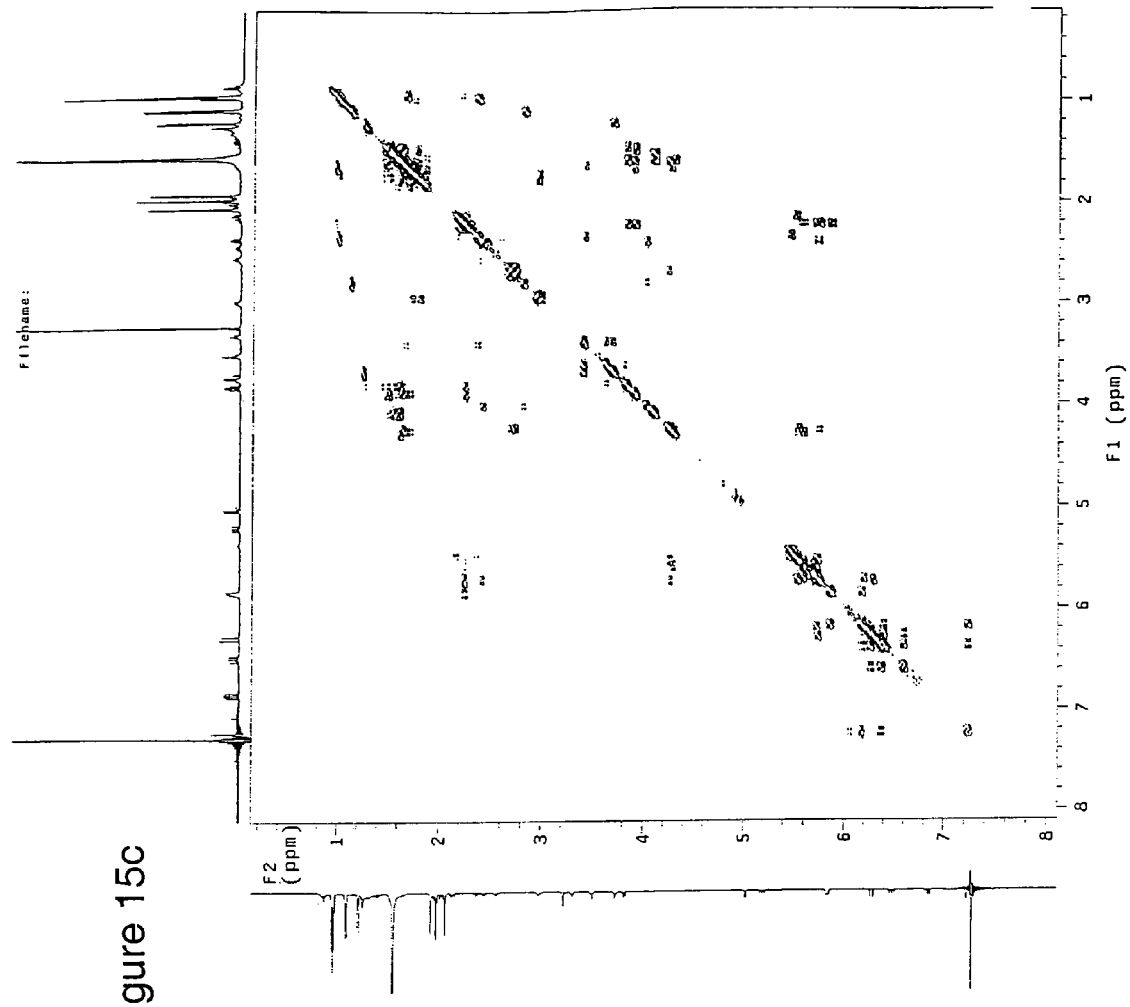
Figure 15D:
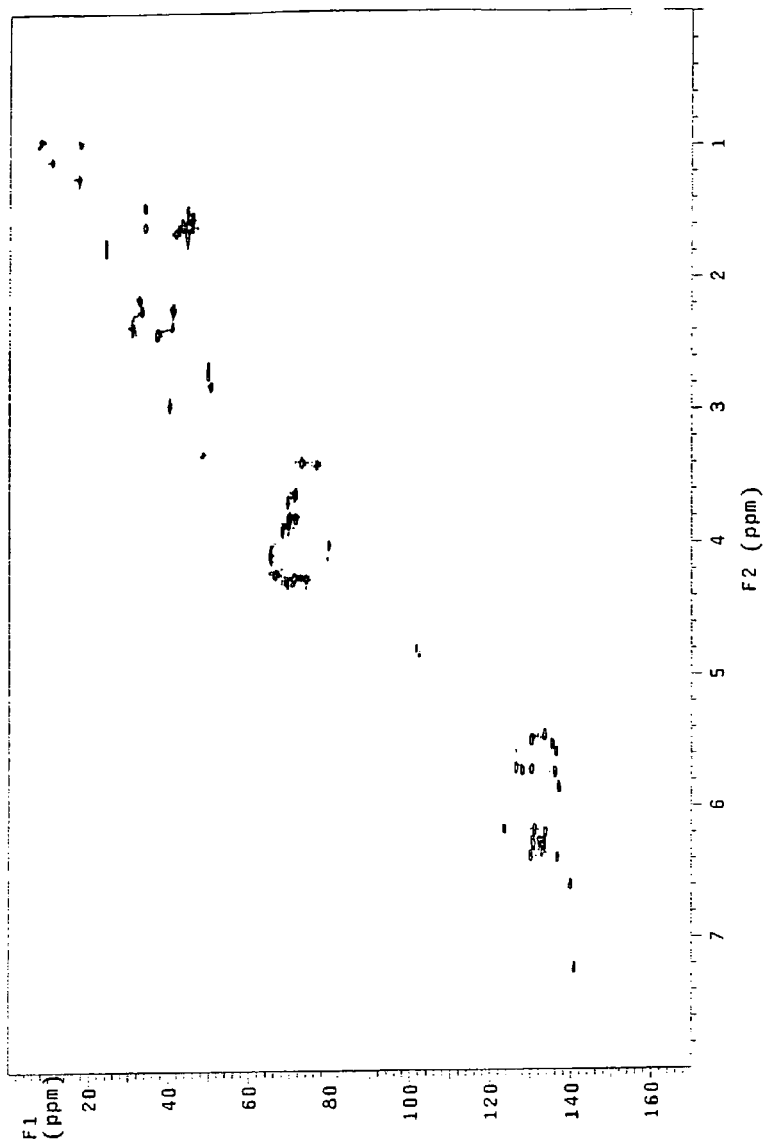
Figure 15E:
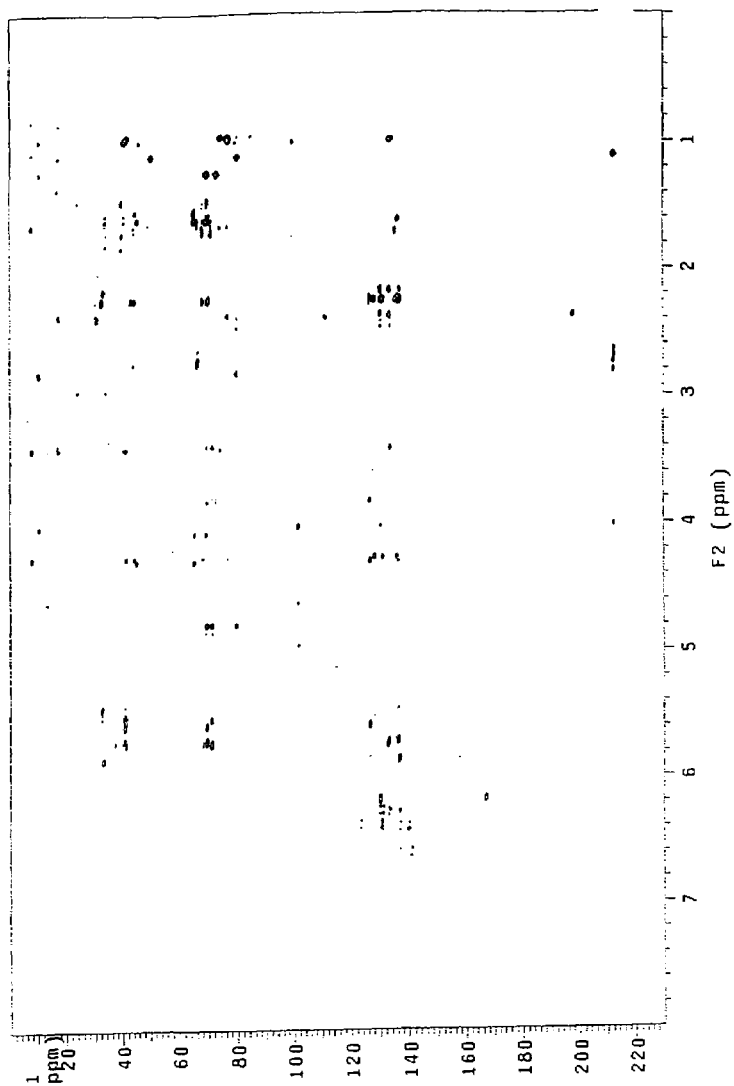
Figure 15F:
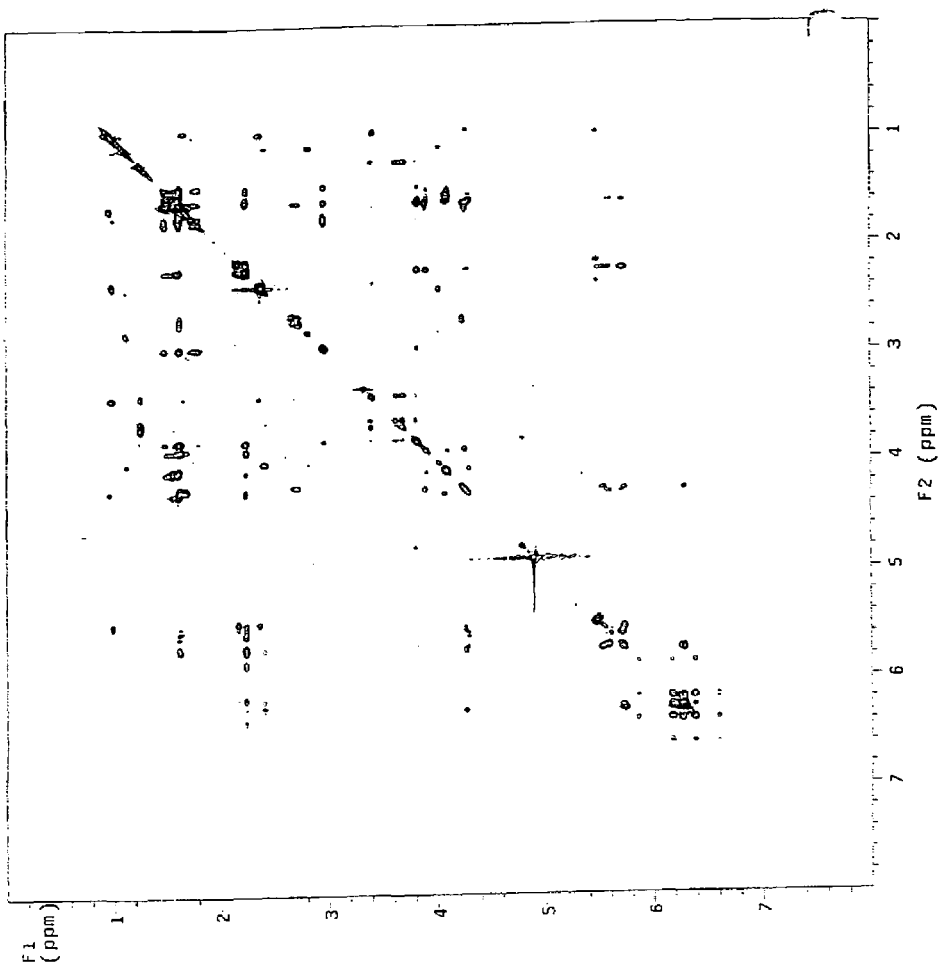

FIG. 14: shows the data for the compound of compound 2(a) obtained by UV $\lambda_{max}$.

FIG. 15: shows the data obtained for the compound of compound 2(a) by NMR at 500 MHz dissolved in $d_3$-MeOH including proton 15A, carbon 15B, and multidimensional pulse sequences gDQCOSY, gHSQC, gHMBC, and TOCSY 15C, 15D, 15E and 15F, respectively.

Figure 16:
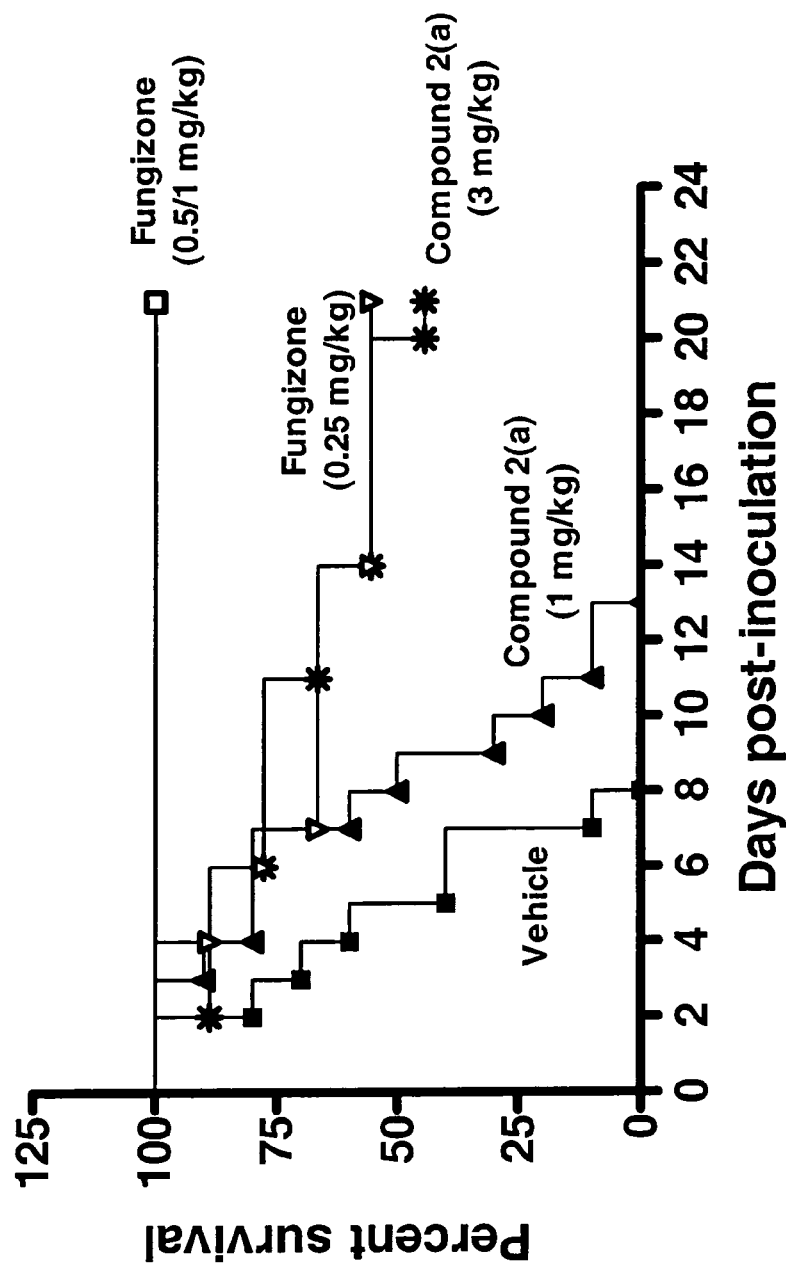

FIG. 16: is a plot of the data from a study to evaluate the antifungal activity of compound 2(a) against *Candida albicans* in a mouse model as described in Example 5. FIG. 16 depicts the percent survival versus days post-inoculation with compound 2(a) (3 mg/kg), compound 2(a) (1 mg/kg), Fungizone (0.25 mg/kg) and Fungizone (0.50 mg/kg).

FIG. 17: proton-NMR (FIG. 17A) and carbon-13 NMR (FIG. 17B) spectral assignments for Compound 2(a) as discussed in Example 3.

DETAILED DESCRIPTION OF THE INVENTION

The present invention encompasses compounds of Formula I, and pharmaceutically acceptable salts thereof:

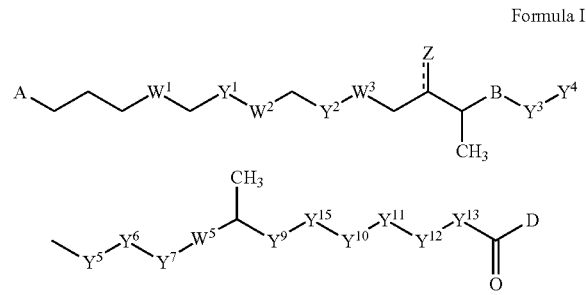

Formula I wherein,

A is selected from the group consisting of —NR$^1$R$^2$, —N═CR$^1$R$^2$,

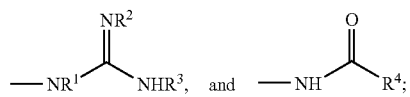

R$^1$, R$^2$, R$^3$ and R$^4$ are each independently selected from the group consisting of H, C$_{1-6}$ alkyl, C$_{2-6}$ alkenyl, C$_{3-6}$ cycloalkyl, C$_{2-6}$ heterocycloatkyl, aryl, heteroaryl and amino acid, wherein said alkyl, alkenyl, aryl and heteroaryl are optionally substituted with a group selected from halogen, OH, NO$_2$, NH$_2$ or aryl, said aryl being optionally further substituted with one or more groups independently selected from halogen, OH, NO$_2$ or NH$_2$;

B is selected from ethene-1,2-diyl or

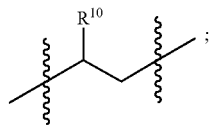

wherein $R^{10}$ is oxo or $OR^{11}$;
wherein $R^{11}$ is H or a heterocycloalkyl, the heterocycloalkyl being optionally substituted with 1-4 substituents selected from OX, $C_{1-3}$ alkyl and $-O-C(O)R^1$, wherein X is H or, when there are at least two neighboring substituent groups that are OX, then the X can be a bond such that the two neighboring oxygen groups form a five-membered acetal ring of the formula:

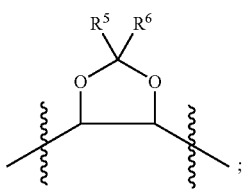

wherein $R^5$ and $R^6$ are each independently selected from the group consisting of H, $C_{1-6}$ alkyl, and $C_{2-7}$ alkenyl;

D is selected from:

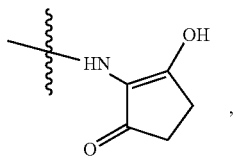

$-NR^{12a}R^{12a}$ and $OR^{12}$, wherein
$R^{12}$ is selected from H, $C_{1-6}$ alkyl optionally substituted with 1 to 2 phenyl groups, wherein the phenyl group is optionally substituted with $C_{1-6}$ alkyl and halo;
$R^{12a}$ and $R^{12a}$ are each independently selected from H, $C_{1-6}$ alkyl, $C_{2-6}$ alkenyl, $C_{3-6}$ cycloalkyl, $C_{2-6}$ heterocycloalkyl, aryl, heteroaryl and amino acid, wherein said alkyl, alkenyl, aryl and heteroaryl are optionally substituted with a group selected from halogen, OH, $NO_2$, $NH_2$ or aryl, said aryl being optionally further substituted with one or more groups independently selected from halogen, OH, $NO_2$ or $NH_2$;

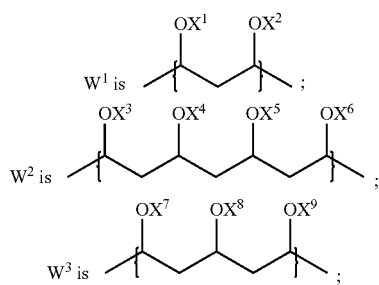

-continued

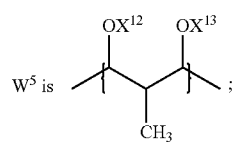

$X^1$, $X^2$, $X^3$, $X^4$, $X^5$, $X^6$, $X^7$, $X^8$, $X^9$, $X^{12}$ and $X^{13}$ are each independently selected from H, $-C(O)-R^7$ and a bond such that when any of two neighboring $X^1$, $X^2$, $X^3$, $X^4$, $X^5$, $X^6$, $X^7$, $X^8$, $X^9$, $X^{12}$ and $X^{13}$ is a bond then the two neighboring oxygen atoms and their attached carbon atoms together form a six-membered acetal ring of the formula:

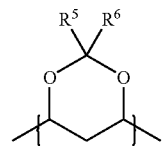

$R^5$, $R^6$ and $R^7$ are each independently selected from H, $C_{1-6}$ alkyl, $C_{2-7}$ alkenyl;
$Y^1$, $Y^2$, $Y^3$, $Y^4$, $Y^6$, $Y^7$, $Y^9$, $Y^{10}$, $Y^{11}$, $Y^{12}$, $Y^{13}$ and $Y^{15}$ are each independently selected from the group consisting of ethene-1,2-diyl, ethane-1,2-diyl and

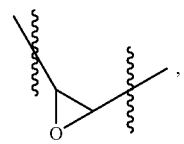

wherein said ethene-1,2-diyl and ethane-1,2-diyl groups are optionally substituted with a methyl group;
Z is selected from OH, $NHR^8$,

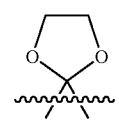

and when the dotted line is a bond then Z is oxo, or $NR^9$;
$R^8$ is selected from H, $C_{1-6}$ alkyl, $C_{2-6}$ alkenyl;
$R^9$ is $C_{1-6}$ alkyl optionally substituted with aryl.

In a first embodiment the invention provides compounds of Formula I wherein Z is oxo; and all other groups are as previously defined; or a pharmaceutically acceptable salt thereof.

Within this first embodiment Z is oxo, A is $-NR^1R^2$; and all other groups are as previously defined; or a pharmaceutically acceptable salt thereof.

Further within this embodiment Z is oxo, A is —NR$^1$R$^2$; and D is

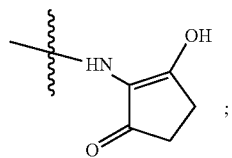

and all other groups are as previously defined; or a pharmaceutically acceptable salt thereof.

Within the first embodiment the invention provides compounds of Formula I wherein Z is oxo and A is

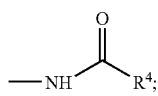

and all other groups are as previously defined; or a pharmaceutically acceptable salt thereof.

Further within this embodiment Z is oxo and A is

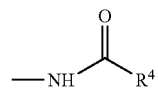

and D is

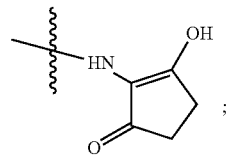

and all other groups are as previously defined; or a pharmaceutically acceptable salt thereof.

In a second embodiment the invention provides compounds of Formula I wherein B is

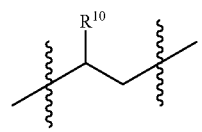

wherein R$^{10}$ is oxo or OR$^{11}$; and all other groups are as previously defined; or a pharmaceutically acceptable salt thereof.

Within this second embodiment R$^{10}$ is OR$^{11}$, wherein R$^{11}$ is a heterocycloalkyl, the heterocycloalkyl being optionally substituted with 1-4 substituents selected from OX, C$_{1-3}$ alkyl and —O—C(O)R$^1$, wherein X is H or, when there are at least two neighboring substituent groups that are OX, then the X can be a bond such that the two neighboring oxygen groups form a five-membered acetal ring of the formula:

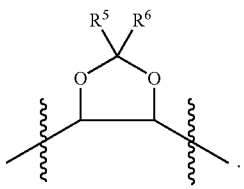

Within this embodiment R$^{11}$ is a heterocycloalkyl, the heterocycloalkyl being optionally substituted with 1-4 substituents selected from OX, C$_{1-3}$ alkyl and —O—C(O)R$^1$, wherein X is H or, when there are at least two neighboring substituent groups that are OX, then the X can be a bond such that the two neighboring oxygen groups form a five-membered acetal ring of the formula:

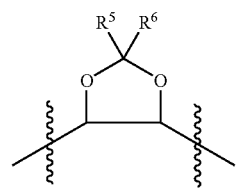

and A is —NR$^1$R$^2$; and all other groups are as previously defined; or a pharmaceutically acceptable salt thereof.

Further within this embodiment the invention provides compounds of Formula I, wherein R$^{11}$ is a heterocycloalkyl, the heterocycloalkyl being optionally substituted with 1-4 substituents selected from OX, C$_{1-3}$ alkyl and —O—C(O)R$^1$, wherein X is H or, when there are at least two neighboring substituent groups that are OX, then the X can be a bond such that the two neighboring oxygen groups form a five-membered acetal ring of the formula:

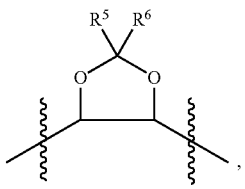

A is —NR$^1$R$^2$ and Z is oxo; and all other groups are as previously defined; or a pharmaceutically acceptable salt thereof.

Preferred compounds of the invention comprise compounds of Formula II:

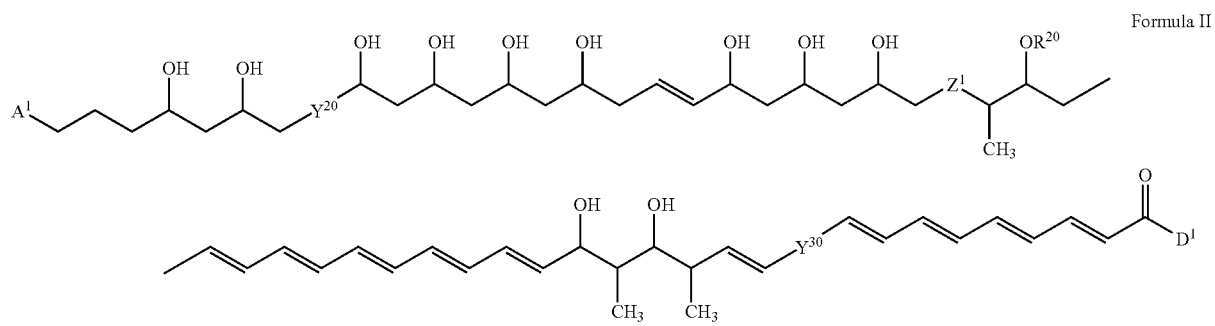
Formula II wherein $A^1$ is —NH$_2$, —N=CH—R$^{13}$, amino acid or —NH—R$^{14}$, wherein R$^{13}$ is hydrogen or phenyl and R$^{14}$ is selected from the group consisting of isopropyl, 1-(4-nitrophenyl)methyl, cyclohexyl, and wherein said amino acid is attached via its nitrogen atom;

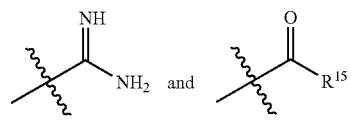

wherein $R^{15}$ is selected from the group consisting of methyl, isopropyl, phenyl, 4-nitrophenyl, 1-aminoethyl, 1-amino-1-(4-hydroxyphenyl)methyl, 1-amino-2-(4-hydroxyphenyl)ethyl, 1-amino-2-methylpropyl, 2-pyrrolidinyl and 1-amino-2-hydroxyethyl;

$Y^{20}$ is selected from the group consisting of ethene-1,2-diyl and

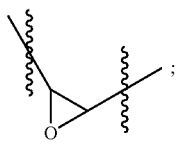

$Z^1$ is selected from the group consisting of:

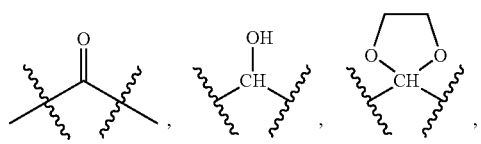

-continued

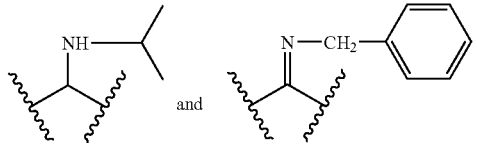
and $R^{20}$ is selected from the group consisting of hydrogen and

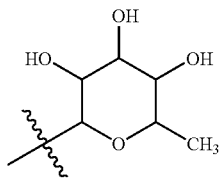

$Y^{30}$ is ethene-1,2-diyl or ethane-1,2-diyl; and
$D^1$ is hydroxy, methoxy or

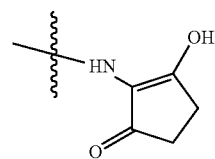

and pharmaceutically acceptable salts thereof.

The present invention includes pharmaceutical compositions of the compounds of Formula II, said compositions comprising a therapeutically effective amount of the compound of Formula II or a pharmaceutically acceptable salt thereof, and a pharmaceutically acceptable carrier.

Particularly preferred compounds of the present invention include those of Formula II

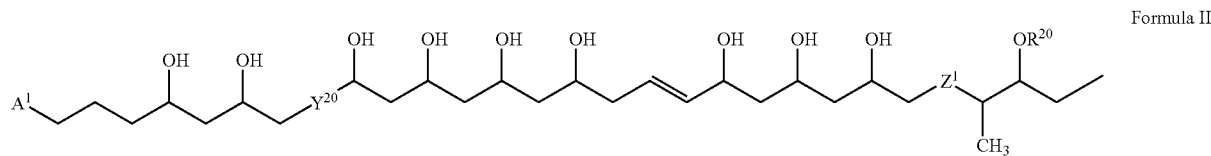
Formula II

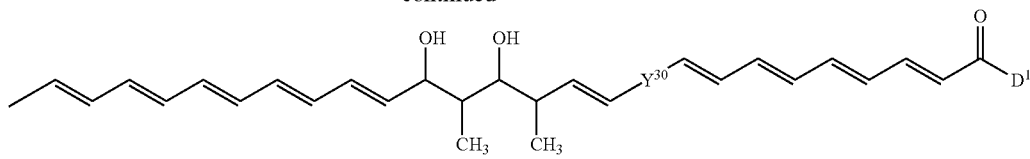

wherein $A^1$ is amino (—$NH_2$), and $Y^{20}$ $Z^1$, $R^{20}$, $Y^{30}$ and $D^1$ are as defined in Table A below.

TABLE A

Compounds of Formula II wherein $A^1$ is $NH_2$

| Compound | $Y^{20}$ | $Z^1$ | $R^{20}$ | $Y^{30}$ | $D^1$ |
|---|---|---|---|---|---|
| 2(a) | ethene-1,2-diyl | ![ketone] | 3,4,5-trihydroxy-6-methyl-tetrahydro-pyran-2-yl | ethane-1,2-diyl | ![HN-cyclopentenone-OH] |
| 2(b) | ![epoxide] | " | 3,4,5-trihydroxy-6-methyl-tetrahydro-pyran-2-yl | " | " |
| 2(c) | ethene-1,2-diyl | ![CH-OH] | 3,4,5-trihydroxy-6-methyl-tetrahydro-pyran-2-yl | " | " |
| 2(d) | " | ![dioxolane] | 3,4,5-trihydroxy-6-methyl-tetrahydro-pyran-2-yl | " | " |
| 2(e) | " | ![N=CH2-Ph] | 3,4,5-trihydroxy-6-methyl-tetrahydro-pyran-2-yl | " | " |
| 2(f) | " | ![NH-iPr] | 3,4,5-trihydroxy-6-methyl-tetrahydro-pyran-2-yl | " | " |
| 2(g) | " | ![ketone] | 3,4,5-trihydroxy-6-methyl-tetrahydro-pyran-2-yl | " | hydroxy |
| 2(h) | " | " | 3,4,5-trihydroxy-6-methyl-tetrahydro-pyran-2-yl | " | methoxy |
| 2(i) | " | " | hydrogen | " | ![HN-cyclopentenone-OH] |

TABLE A-continued

Compounds of Formula II wherein $A^1$ is $NH_2$

| Compound | $Y^{20}$ | $Z^1$ | $R^{20}$ | $Y^{30}$ | $D^1$ |
|---|---|---|---|---|---|
| 2(j) | " | " | " | " | hydroxy |
| 2(k) | " | " | 3,4,5-trihydroxy-6-methyl-tetrahydro-pyran-2-yl | ethene-1,2-diyl | 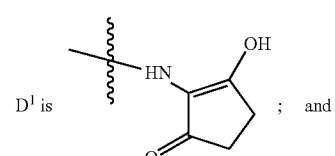 |
| 2(l) | " | 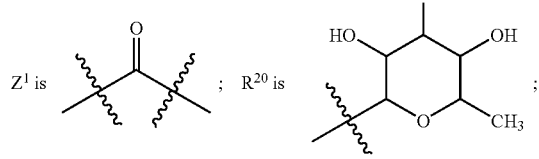 | 3,4,5-trihydroxy-6-methyl-tetrahydro-pyran-2-yl | " | " |

Additional preferred compounds of the invention include compounds of Formula II

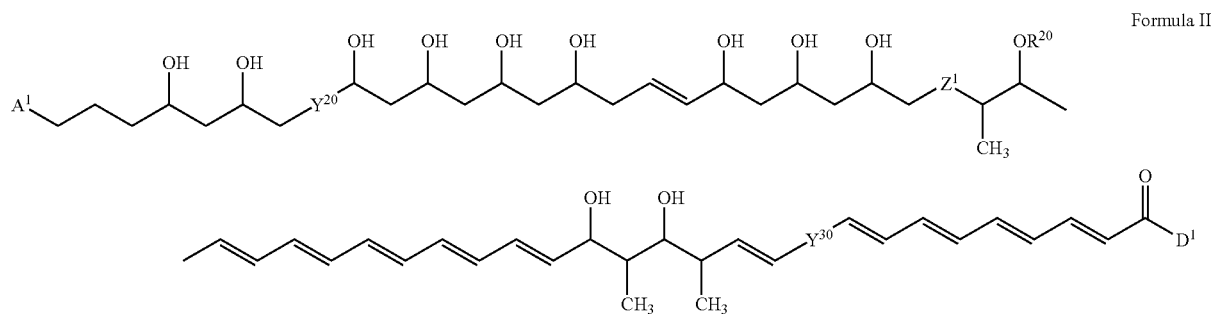

Formula II as set forth in Tables B and C below,
wherein $Y^{20}$ is ethene-1,2-diyl;

$Z^1$ is

; $R^{20}$ is

;

$Y^{30}$ is ethane-1,2-diyl; and $D^1$ is

; and wherein $A^1$ is —N=CH—$R^{13}$ (Table B); —NH—$R^{14}$ (Table C).

TABLE B

Compounds of Formula II wherein $A^1$ is —N=CH—$R^{13}$ and $Y^{20}$, $Z^1$, $R^{20}$, $Y^{30}$ and $D^1$ are as defined above.

| Compound | $R^{13}$ |
|---|---|
| 2(m) | $CH_3$ |
| 2(n) | phenyl |

TABLE C

Compounds of Formula II wherein $A^1$ is —NH—$R^{14}$ and $Y^{20}$, $Z^1$, $R^{20}$, $Y^{30}$ and $D^1$ are as defined above.

| Compound | $R^{14}$ | $R^{15}$ |
|---|---|---|
| 2(o) | (NH, NH₂ group structure) | NA* |
| 2(p) | isopropyl | NA |
| 2(q) | 1-(4-nitrophenyl)methyl | NA |
| 2(r) | cyclohexyl | NA |

TABLE C-continued

Compounds of Formula II wherein $A^1$ is —NH—$R^{14}$ and $Y^{20}$, $Z^1$, $R^{20}$, $Y^{30}$ and $D^1$ are as defined above.

| Compound | $R^{14}$ | $R^{15}$ |
|---|---|---|
| 2(s) | ![acyl group with R15] | $CH_3$ |
| 2(t) | ![acyl group with R15] | isopropyl |
| 2(u) | ![acyl group with R15] | phenyl |
| 2(v) | ![acyl group with R15] | 4-nitrophenyl |
| 2(w) | ![acyl group with R15] | 1-aminoethyl |
| 2(x) | ![acyl group with R15] | 1-amino-1-(4-hydroxyphenyl)methyl |
| 2(y) | ![acyl group with R15] | 1-amino-2-(4-hydroxyphenyl)ethyl |
| 2(z) | ![acyl group with R15] | 1-amino-2-methylpropyl |
| 2(aa) | ![acyl group with R15] | 2-pyrrolidinyl |
| 2(ab) | ![acyl group with R15] | 1-amino-2-hydroxyethyl |

*NA = not applicable

The compounds of Tables A, B and C are shown below.

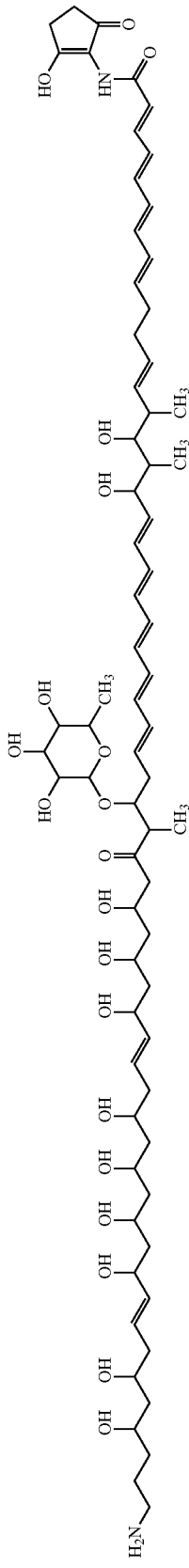
Compound 2(a)
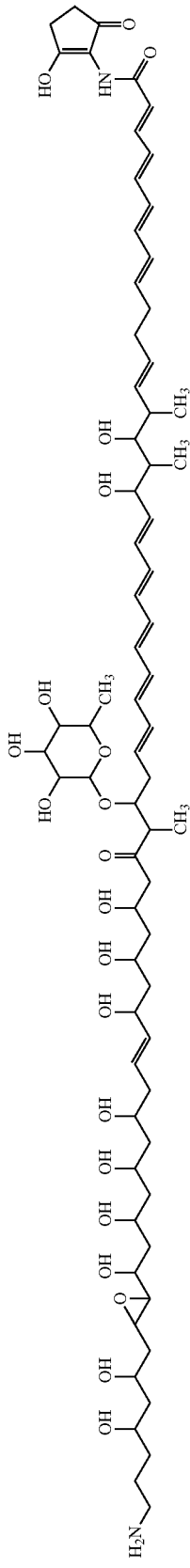
Compound 2(b)
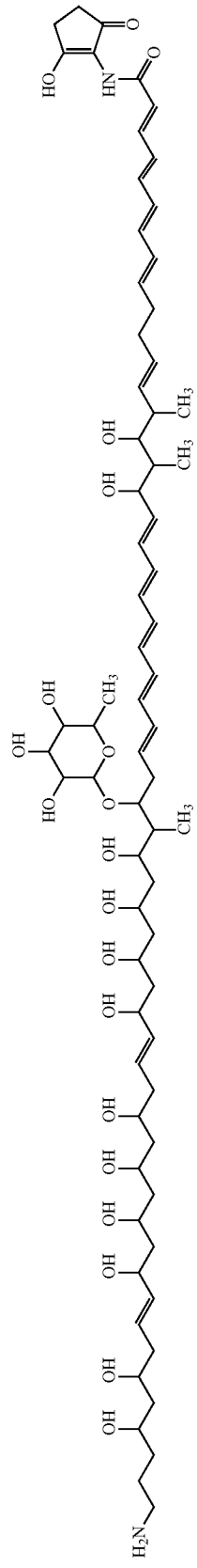
Compound 2(c)
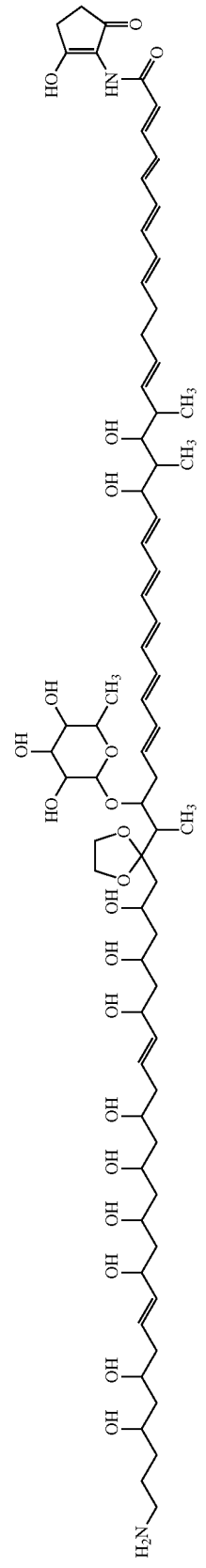
Compound 2(d)

-continued
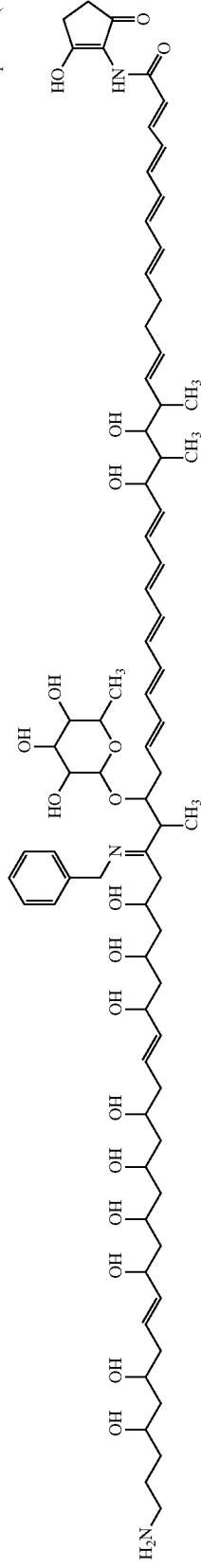
Compound 2(e)
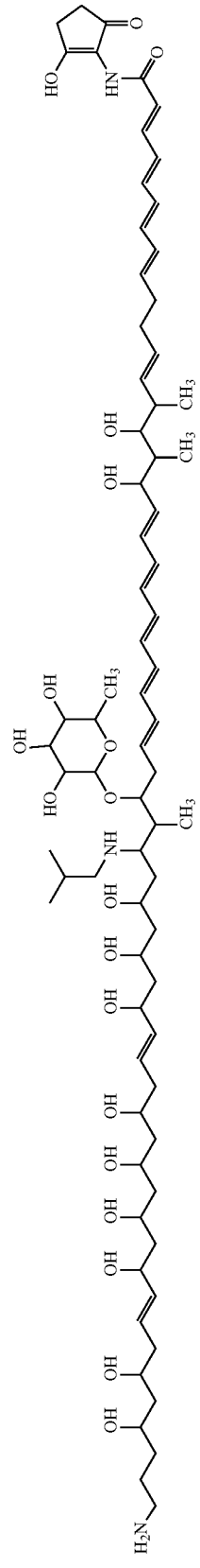
Compound 2(f)
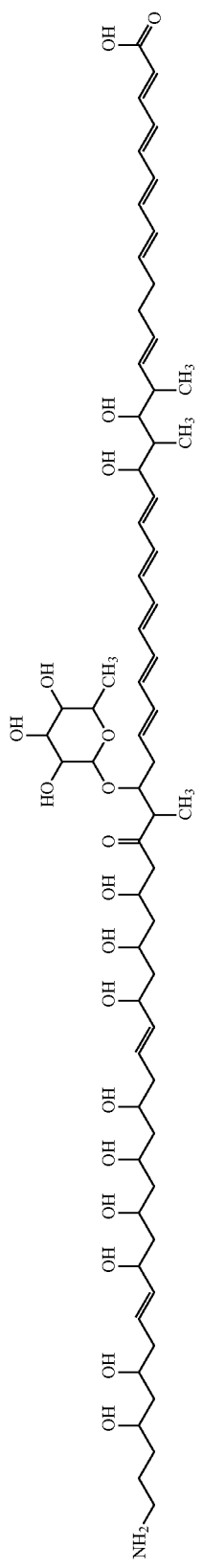
Compound 2(g)
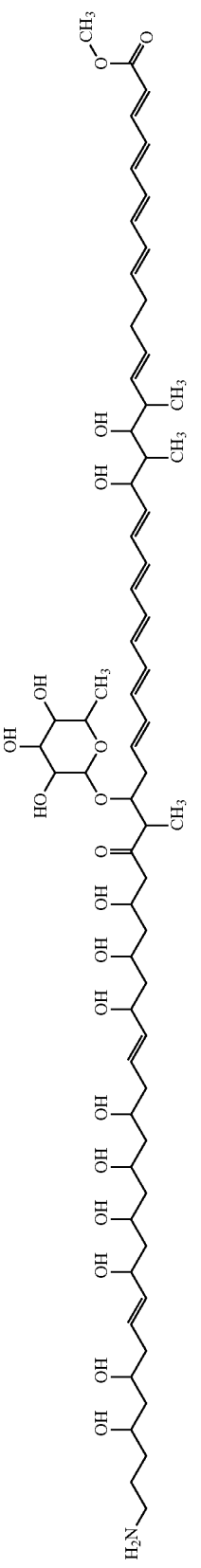
Compound 2(h)

-continued
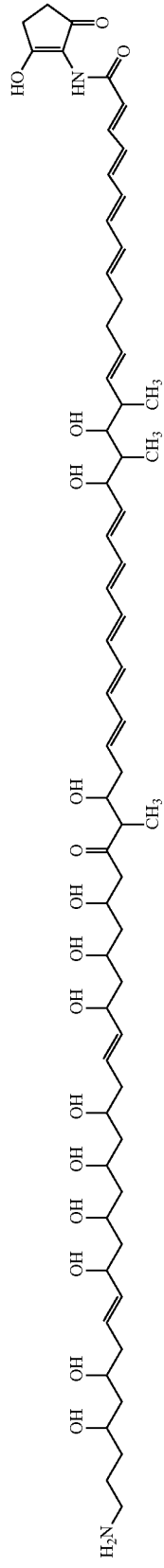
Compound 2(i)
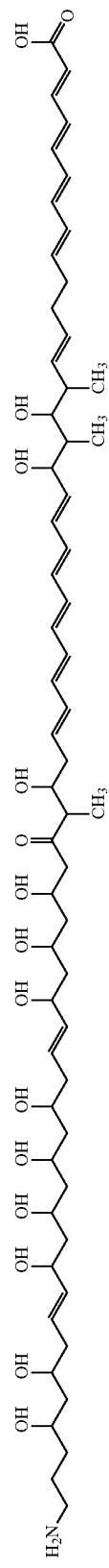
Compound 2(j)
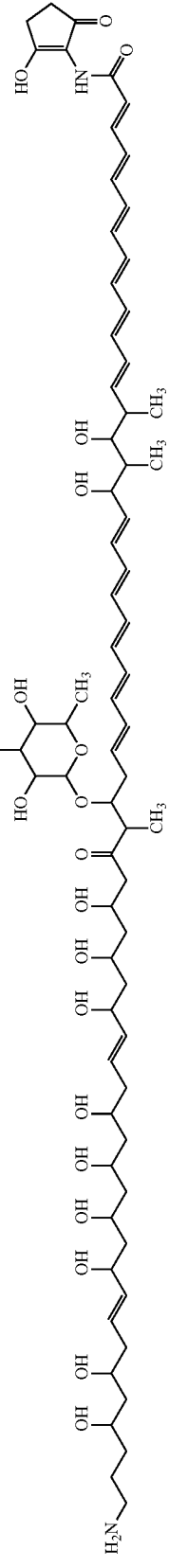
Compound 2(k)
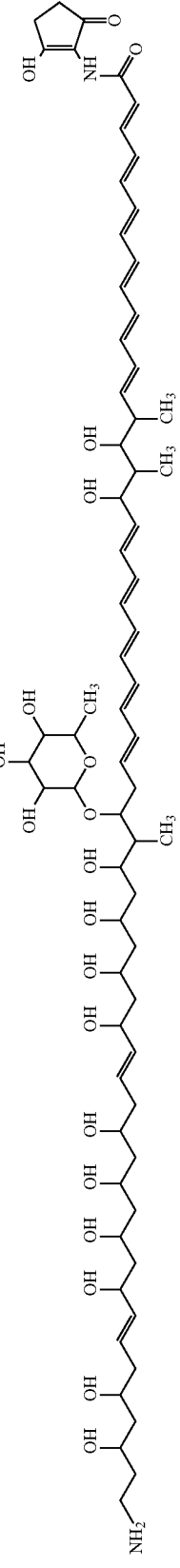
Compound 2(l)

-continued
Compound 2(m)
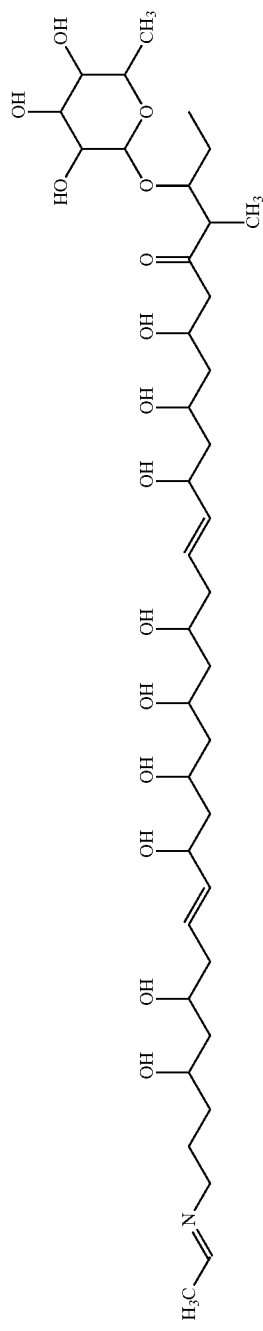
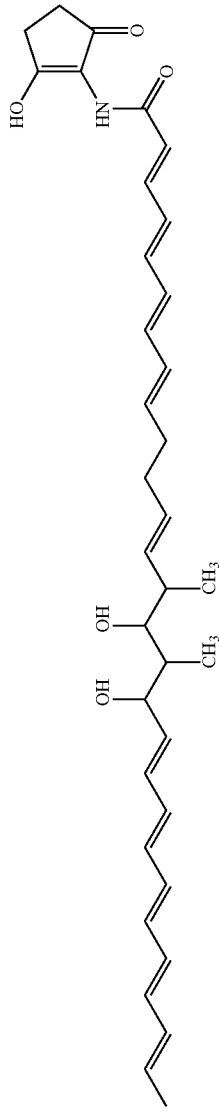
Compound 2(n)
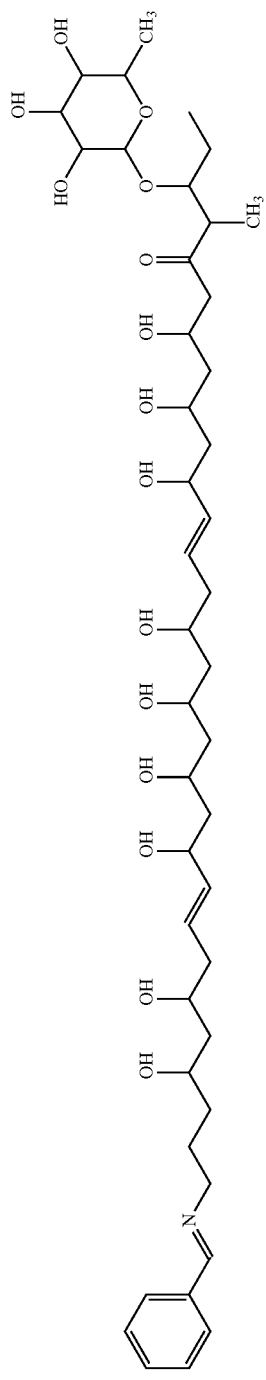
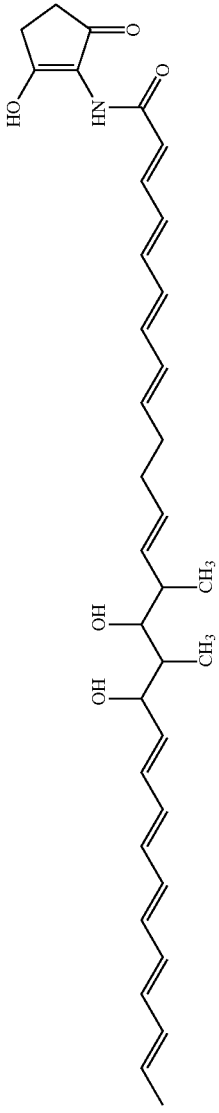

Compound 2(o)
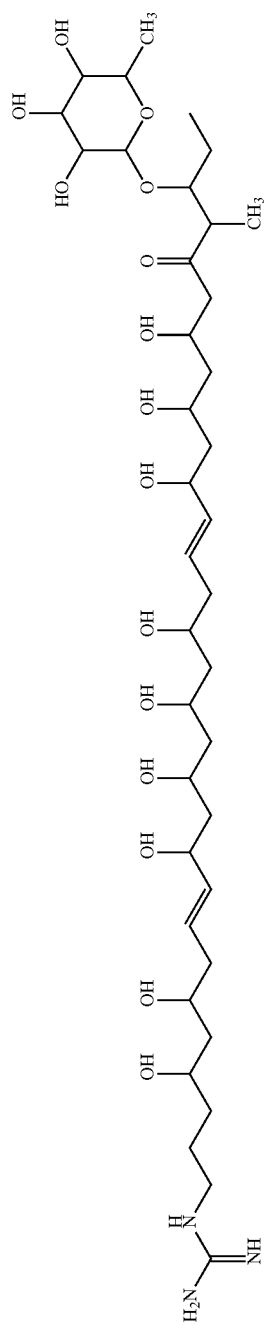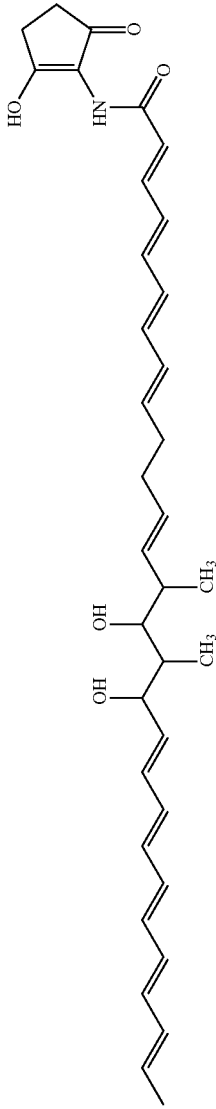
Compound 2(p)
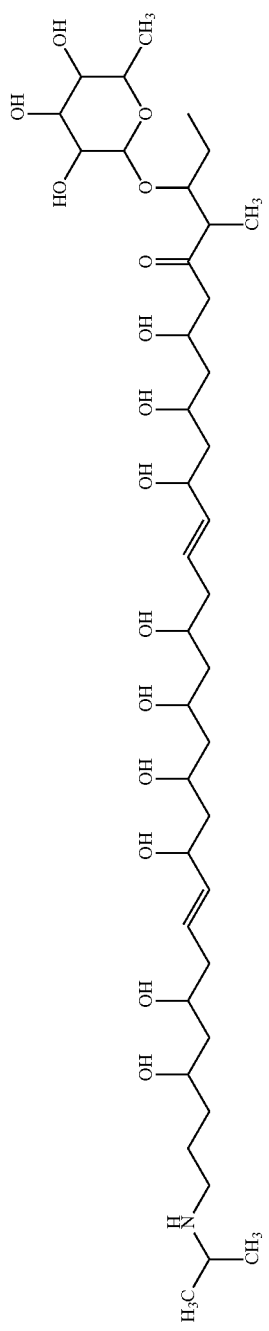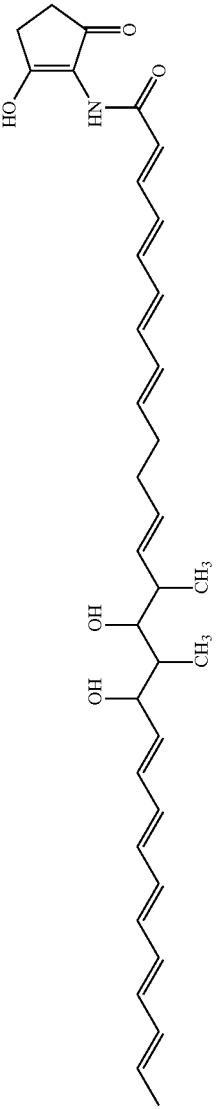

-continued
Compound 2(q)
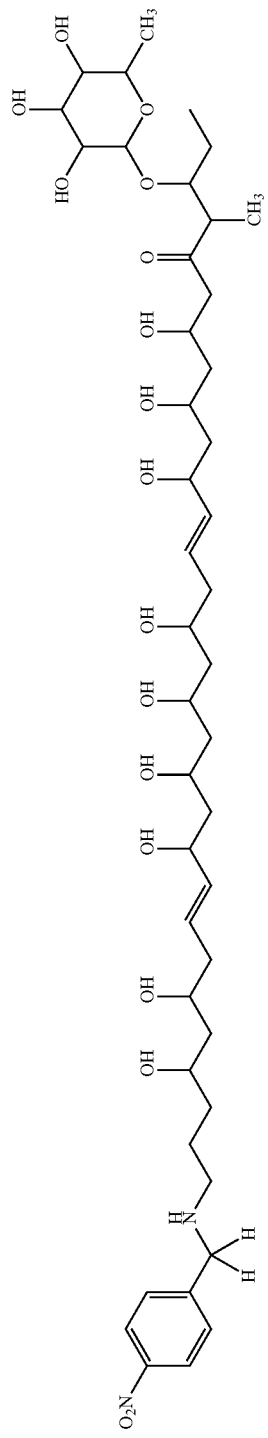
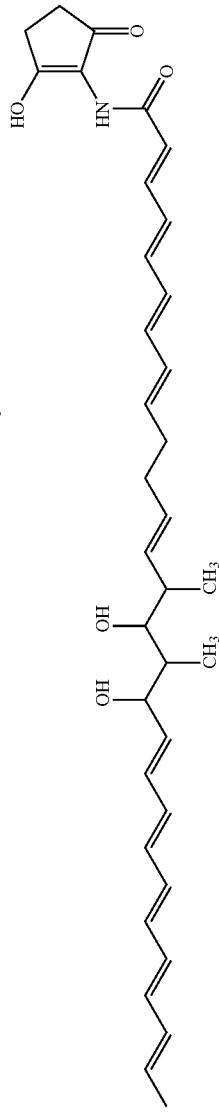
Compound 2(r)
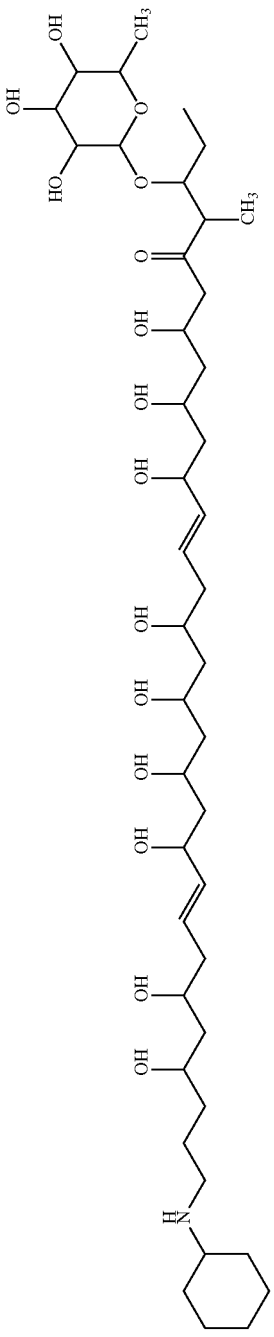
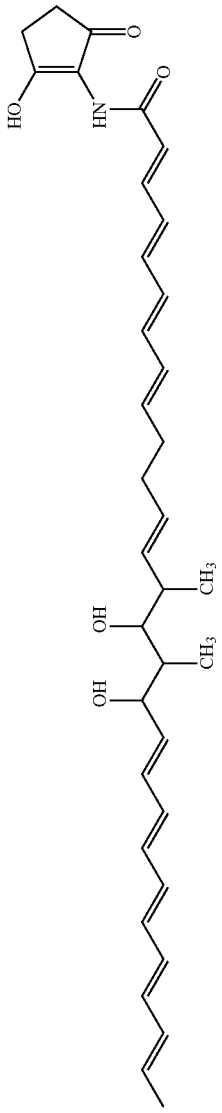

-continued
Compound 2(s)
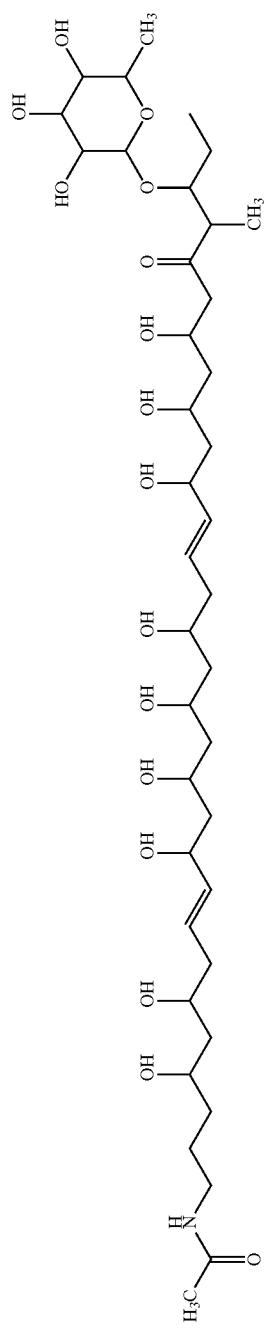
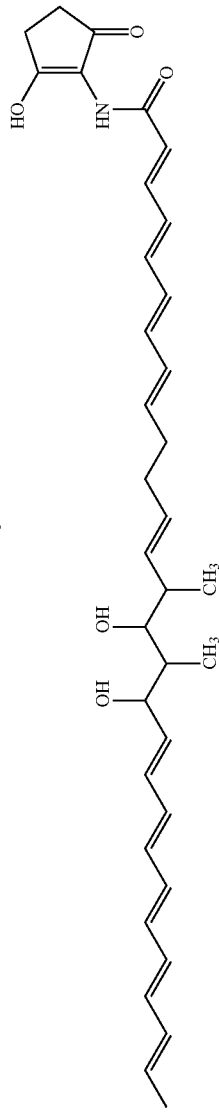
Compound (t)
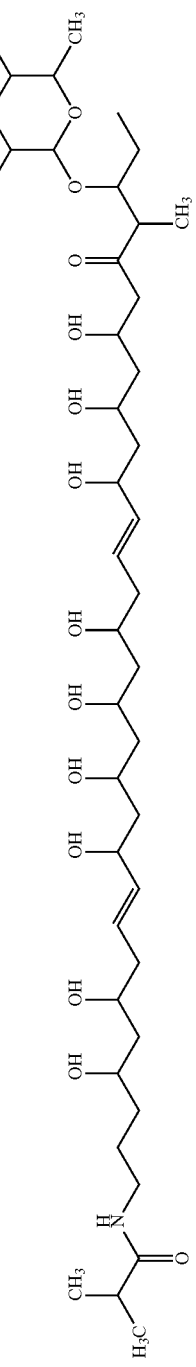
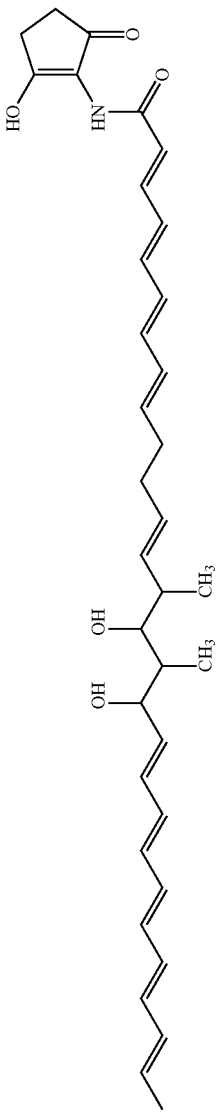

-continued
Compound 2(u)
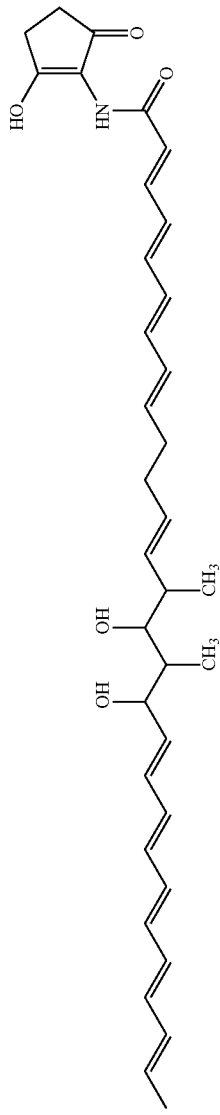
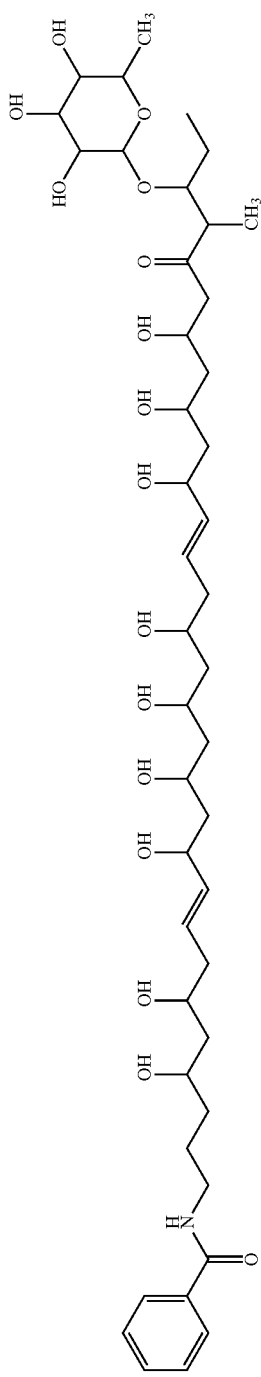
Compound 2(v)
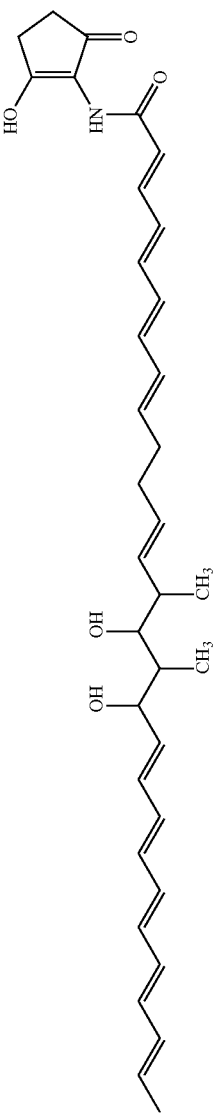
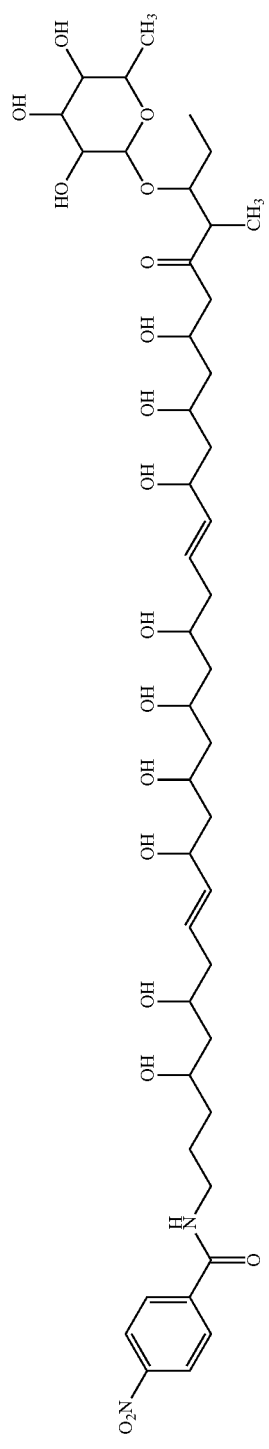

-continued
Compound 2(w)
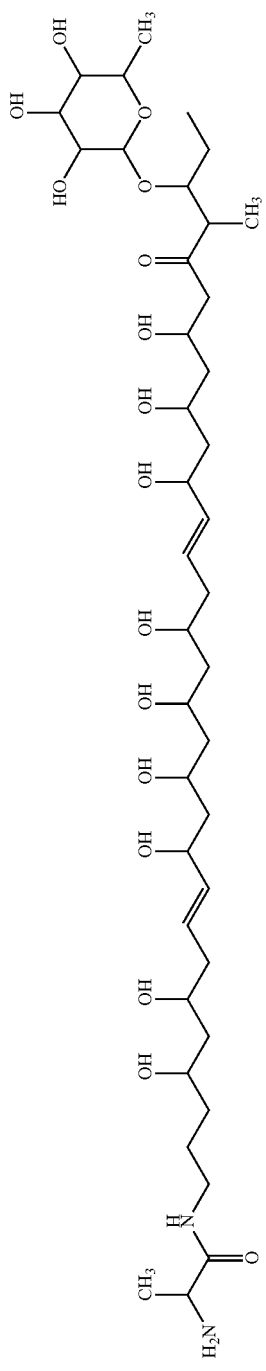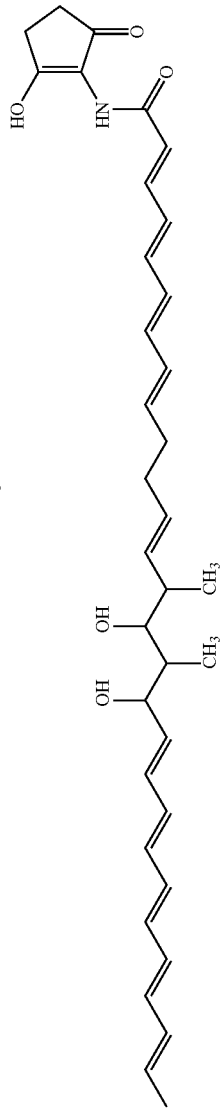
Compound 2(x)
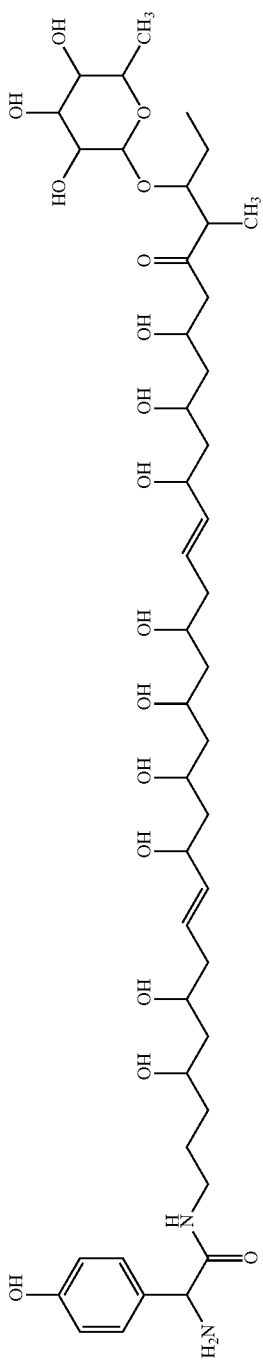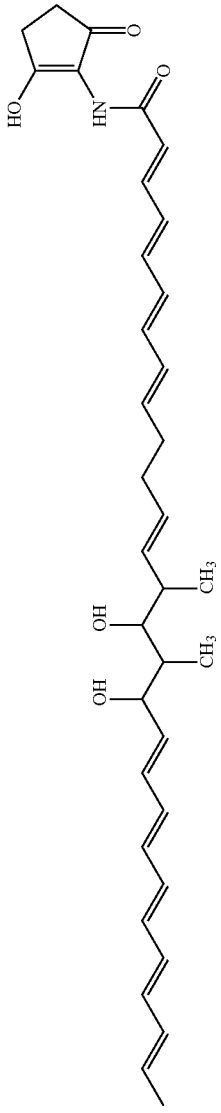

-continued
Compound 2(y)
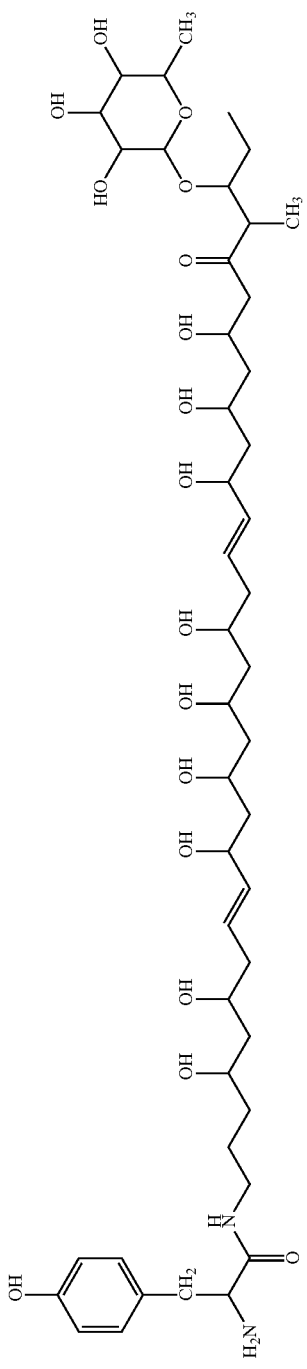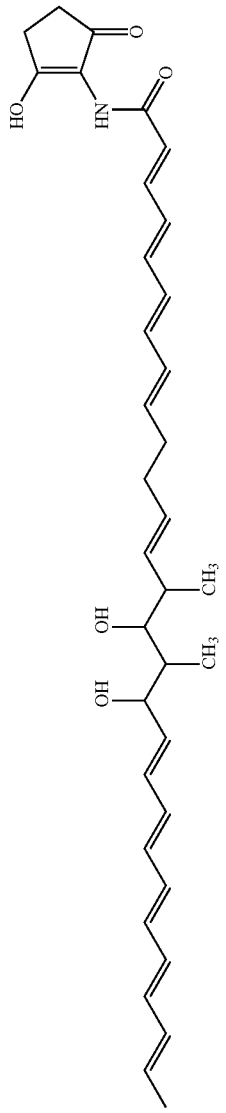
Compound 2(z)
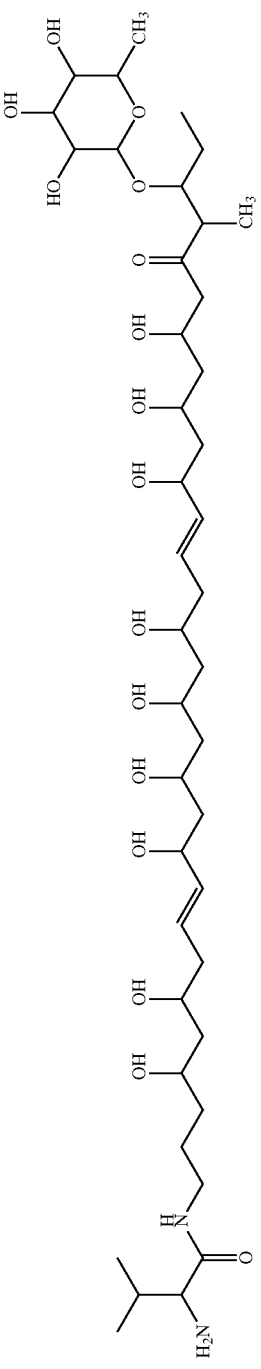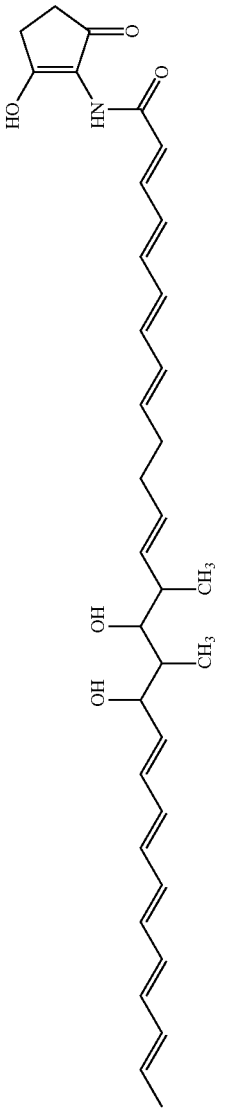

-continued
Compound 2(aa)
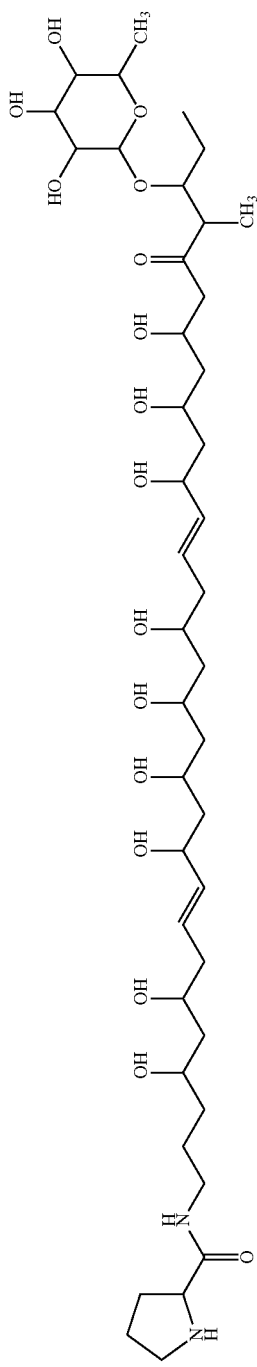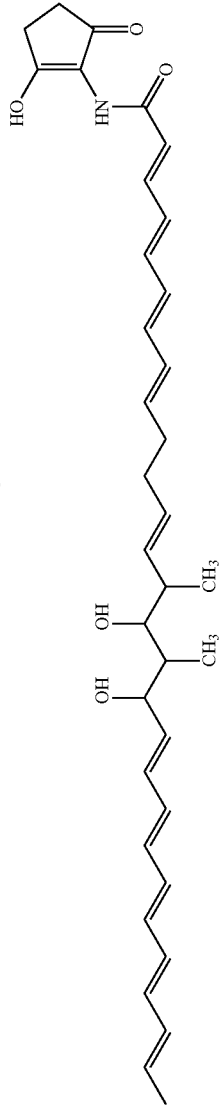
Compound 2(ab)
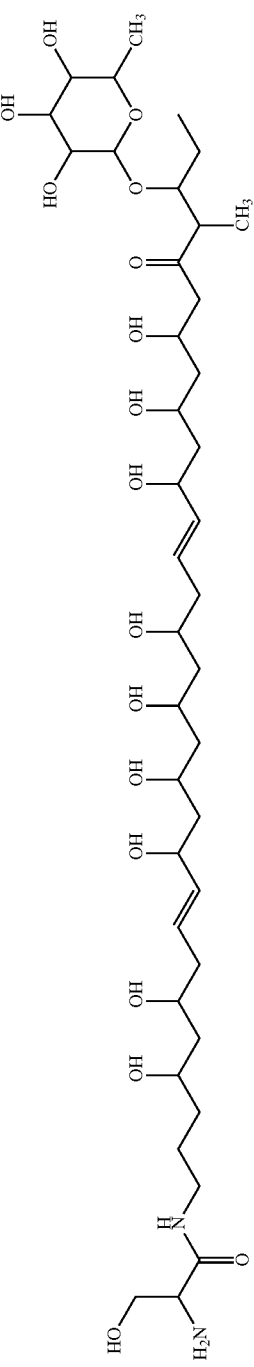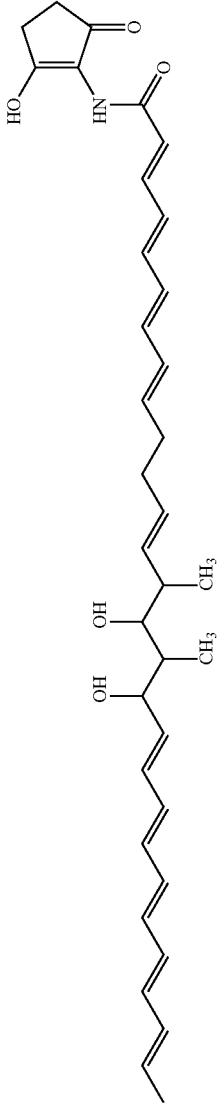

The following bivalent moieties are referred to herein by the nomenclature as indicated below:

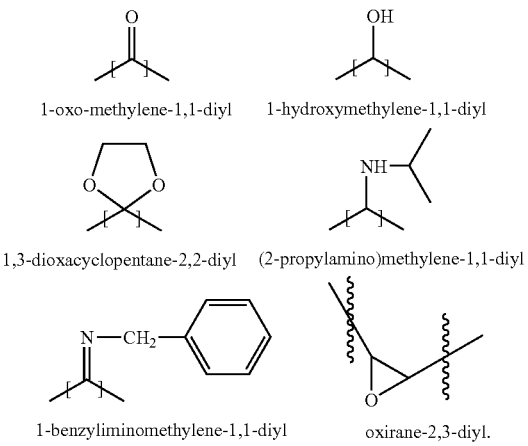

1-oxo-methylene-1,1-diyl    1-hydroxymethylene-1,1-diyl 1,3-dioxacyclopentane-2,2-diyl    (2-propylamino)methylene-1,1-diyl 1-benzyliminomethylene-1,1-diyl    oxirane-2,3-diyl.

The following monovalent moieties are referred to herein by the nomenclature as indicated:

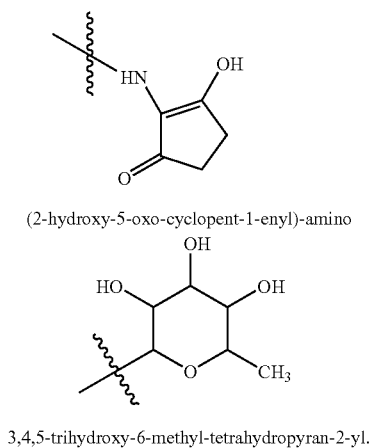

(2-hydroxy-5-oxo-cyclopent-1-enyl)-amino 3,4,5-trihydroxy-6-methyl-tetrahydropyran-2-yl.

The terms "polyketide" or "polyene polyketide" refer to a class of polyketide compounds defined by Formula I or II. A preferred polyketide of the invention is the compound 2a, having the systematic name 56-Amino-15,17,33,35,37,41, 43,45,47,51,53-undecahydroxy-14,16,30-trimethyl-31-oxo-29-(3,4,5-trihydroxy-6-methyl-tetrahydro-pyran-2-yloxy)-hexapentaconta-2,4,6,8,12,18,20,22,24,26,38,48-dodecaenoic acid (2-hydroxy-5-oxo-cyclopent-1-enyl)-amide. The term further includes compounds of this class that can be used as intermediates in chemical synthesis.

The terms "producer of compounds of Formula I" and "compounds of Formula I -producing organism" refer to a microorganism that carries genetic information necessary to produce a compound of Formula I, whether or not the organism is known to produce a compound of Formula I. The terms "producer of compounds of Formula II" and "compound of Formula II-producing organism" refer to a microorganism that carries genetic information necessary to produce a compound of Formula II, whether or not the organism is known to produce a compound of Formula II. The terms "producer of Compound 2(a)" and "Compound 2(a)-producing organism" refer to a microorganism that carries genetic information necessary to produce Compound 2(a), whether or not the organism is known to produce Compound 2(a). The term "polyketide producer" refer to a microorganism that carries genetic information necessary to produce a polyketide of Formula I or II. The terms apply equally to organisms in which the genetic information to produce the compound of Formula I or II or Compound 2(a) is found in the organism as it exists in its natural environment, and to organisms in which the genetic information is introduced by recombinant techniques. For the sake of particularity, specific organisms contemplated herein include organisms of the family Micromonosporaceae, of which preferred genera include *Micromonospora, Actinoplanes* and *Dactylosporangium*; the family Streptomycetaceae, of which preferred genera include *Streptomyces* and *Kitasatospora*; the family Pseudonocardiaceae, of which preferred genera are *Amycolatopsis* and *Saccharopolyspora*; and the family Actinosynnemataceae, of which preferred genera include *Saccharothrix* and *Actinosynnema*; however the terms are intended to encompass all organisms containing genetic information necessary to produce a compound of Formula I or II or Compound 2(a). Preferred producers of a compound of formula I or II or Compound 2(a) include *Streptomyces aizunensis* (NRRL B-11277) and any mutant or improved strain of *Streptomyces aizunensis*, including strain [C03]023 (IDAC accession no. 070803-01) and strain [C03U03]023 (IDAC accession no. 231203-02).

The term "isolated" means that the material is removed from its original environment, e.g. the natural environment if it is naturally-occurring. For example, a naturally occurring polynucleotide or polypeptide present in a living organism is not isolated, but the same polynucleotide or polypeptide, separated from some or all of the coexisting materials in the natural system, is isolated. Such polynucleotides could be part of a vector and/or such polynucleotides or polypeptides could be part of a composition, and still be isolated in that such vector or composition is not part of its natural environment.

The term "purified" does not require absolute purity; rather, it is intended as a relative definition. Individual nucleic acids obtained from a library have been conventionally purified to electrophoretic homogeneity. The purified nucleic acids of the present invention have been purified from the remainder of the genomic DNA in the organism by at least $10^4$ to $10^6$ fold. However, the term "purified" also includes nucleic acids which have been purified from the remainder of the genomic DNA or from other sequences in a library or other environment by at least one order of magnitude, preferably two or three orders of magnitude, and more preferably four or five orders of magnitude.

"Recombinant" means that the nucleic acid is present in the cell with "backbone" nucleic acid, wherein the nucleic acid is not present with "backbone" nucleic acid in its natural environment. "Recombinant" can also be defined to mean that the nucleic acid is adjacent to "backbone" nucleic acid to which it is not adjacent in its natural environment. "Enriched" nucleic acids represent 5% or more of the number of nucleic acid inserts in a population of nucleic acid backbone molecules. "Backbone" molecules include nucleic acids such as expression vectors, self-replicating nucleic acids, viruses, integrating nucleic acids, and other vectors or nucleic acids used to maintain or manipulate a nucleic acid of interest. Preferably, the enriched nucleic acids represent 15% or more, more preferably 50% or more, and most preferably 90% or more, of the number of nucleic acid inserts in the population of recombinant backbone molecules.

"Recombinant" polypeptides or proteins refer to polypeptides or proteins produced by recombinant DNA techniques, i.e. produced from cells transformed by an exogenous DNA construct encoding the desired polypeptide or protein. "Synthetic" polypeptides or proteins are those prepared by chemical synthesis.

The term "gene" means the segment of DNA involved in producing a polypeptide chain; it includes regions preceding and following the coding region (leader and trailer) as well as, where applicable, intervening regions (introns) between individual coding segments (exons).

The terms "gene locus, "gene cluster," and "biosynthetic locus" refer to a group of genes or variants thereof involved in the biosynthesis of the polyketide of Formula 2a. Genetic modification of gene locus, gene cluster or biosynthetic locus refers to any genetic recombinant techniques known in the art including mutagenesis, inactivation, or replacement of nucleic acids that can be applied to generate variants of the compounds of Formula 2a. Genetic modification of gene locus, gene cluster or biosynthetic locus refers to any genetic recombinant techniques known in the art including mutagenesis, inactivation, or replacement of nucleic acids that can be applied to generate genetic variants of compounds of Formula I.

A DNA or nucleotide "coding sequence" or "sequence encoding" a particular polypeptide or protein, is a DNA sequence which is transcribed and translated into a polypeptide or protein when placed under the control of appropriate regulatory sequences.

"Oligonucleotide" refers to a nucleic acid, generally of at least 10, preferably 15 and more preferably at least 20 nucleotides, preferably no more than 100 nucleotides, that are hybridizable to a genomic DNA molecule, a cDNA molecule, or an mRNA molecule encoding a gene, mRNA, cDNA or other nucleic acid of interest.

A promoter sequence is "operably linked to" a coding sequence recognized by RNA polymerase which initiates transcription at the promoter and transcribes the coding sequence into mRNA.

"Digestion" of DNA refers to enzymatic cleavage of the DNA with a restriction enzyme that acts only at certain sequences in the DNA. The various restriction enzymes used herein are commercially available and their reaction conditions, cofactors and other requirements were used as would be known to the ordinary skilled artisan. For analytical purposes, typically 1 pg of plasmid or DNA fragment is used with about 2 units of enzyme in about 20 μl of buffer solution. For the purpose of isolating DNA fragments for plasmid construction, typically 5 to 50 μg of DNA are digested with 20 to 250 units of enzyme in a larger volume. Appropriate buffers and substrate amounts for particular enzymes are specified by the manufacturer. Incubation times of about 1 hour at 37° C. are ordinarily used, but may vary in accordance with the supplier's instructions. After digestion, gel electrophoresis may be performed to isolate the desired fragment.

As used herein and as known in the art, the term "identity" is the relationship between two or more polynucleotide sequences, as determined by comparing the sequences. Identity also means the degree of sequence relatedness between polynucleotide sequences, as determined by the match between strings of such sequences. Identity can be readily calculated (see, e.g., Computation Molecular Biology, Lesk, A. M., eds., Oxford University Press, New York (1998), and Biocomputing: Informatics and Genome Projects, Smith, D. W., ed., Academic Press, New York (1993), both of which are incorporated by reference herein).

While there exist a number of methods to measure identity between two polynucleotide sequences, the term is well known to skilled artisans (see, e.g., Sequence Analysis in Molecular Biology, von Heinje, G., Academic Press (1987); and Sequence Analysis Primer, Gribskov., M. and Devereux, J., eds., M. Stockton Press, New York (1991)). Methods commonly employed to determine identity between sequences include, for example, those disclosed in Carillo, H., and Lipman, D., SIAM J. Applied Math. (1988) 48:1073. "Substantially identical," as used herein, means there is a very high degree of homology (preferably 100% sequence identity) between subject polynucleotide sequences. However, polynucleotides having greater than 90%, or 95% sequence identity may be used in the present invention, and thus sequence variations that might be expected due to genetic mutation, strain polymorphism, or evolutionary divergence can be tolerated.

The biosynthetic locus for the production of the Compound 2(a) spans approximately 176,000 base pairs of DNA and encodes 38 proteins. More than 10 kilobases of DNA sequence were analyzed on each side of the locus and these regions were found to contain primary metabolic genes. The order and relative position of the 38 open reading frames representing the proteins of the biosynthetic locus for Compound 2(a) are provided in FIG. 1. Referring to FIG. 1, the genes involved in the biosynthesis of Compound 2(a) are contained within two contiguous nucleotide sequences (SEQ ID NOS: 1 and 18). The contiguous nucleotide sequences are arranged such that, as found within the compound 2(a) biosynthetic locus, the 3' end of the 11740 base pairs of DNA of contig 1 (SEQ ID NO: 1) is found adjacent to the 5' end of the 164,051 base pairs of DNA of contig 2 (SEQ ID NO: 18).

The nucleotide sequence and polypeptide sequences relating to the locus of compound 2(a) are provided in the sequence listing filed together with and forming part of this application. SEQ ID NO: 1 is the 11740 contiguous base pairs of contig 1 comprising eight open reading frames, namely ORF 1 to ORF 8 listed in SEQ ID NOS: 3, 5, 7, 9, 11, 13, 15 and 17 respectively. The gene product of ORF 1 (SEQ ID NO: 2) is the 719 amino acids deduced from the nucleic acid sequence of SEQ ID NO: 3 which is drawn from residues 418 to 2577 (sense strand) of contig 1 (SEQ ID NO: 1). The gene product of ORF 2 (SEQ ID NO: 4) is the 253 amino acids deduced from the nucleic acid sequence of SEQ ID NO: 5 which is drawn from residues 3006 to 3767 (sense strand) of contig 1 (SEQ ID NO: 1). The gene product of ORF 3 (SEQ ID NO: 6) is the 956 amino acids deduced from the nucleic acid sequence of SEQ ID NO: 7 which is drawn from residues 4016 to 6886 (sense strand) of contig 1 (SEQ ID NO: 1). The gene product of ORF 4 (SEQ ID NO: 8) is the 201 amino acids deduced from the nucleic acid sequence of SEQ ID NO: 9 which is drawn from residues 7581 to 6976 (antisense strand) of contig 1 (SEQ ID NO: 1). The gene product of ORF 5 (SEQ ID NO: 10) is the 416 amino acids deduced from the nucleic acid sequence of SEQ ID NO: 11 which is drawn from residues 8848 to 7598 (antisense strand) of contig 1 (SEQ ID NO: 1). The gene product of ORF 6 (SEQ ID NO: 12) is the 186 amino acids deduced from the nucleic acid sequence of SEQ ID NO: 13 which is drawn from residues 9053 to 9613 (sense strand) of contig 1 (SEQ ID NO: 1). The gene product of ORF 7 (SEQ ID NO: 14) is the 163 amino acids deduced from the nucleic acid sequence of SEQ ID NO: 15 which is drawn from residues 9682 to 10173 (sense strand) of contig 1 (SEQ ID NO: 1). The gene product of ORF 8 (SEQ ID NO: 16) is the 514 amino acids deduced from the nucleic acid sequence of SEQ ID NO: 17 which is drawn from residues 10170 to 11714 (sense strand) of contig 1 (SEQ ID NO: 1).

SEQ ID NO: 18 is the 164,051 contiguous base pairs of contig 2 comprising 30 ORFs, namely ORF 9 to ORF 38 listed in SEQ ID NOS: 20, 22, 24, 26, 28, 30, 32, 34, 36, 38, 40, 42, 44, 46, 48, 50, 52, 54, 56, 58, 60, 62, 64, 66, 68, 70, 72, 74, 76 and 78 respectively. The gene product of ORF 9 (SEQ ID NO: 19) is the 367 amino acids deduced from the nucleic acids sequence of SEQ ID NO: 20 which is drawn from residues 1109 to 6 (antisense strand) of contig 2 (SEQ ID NO: 18). The gene product of ORF 10 (SEQ ID NO: 21) is the 8147 amino acids deduced from the nucleic acid sequence of SEQ ID NO: 22 which is drawn from residues 1375 to 25818 (sense strand) of contig 2 (SEQ ID NO: 18). The gene product of ORF 11 (SEQ ID NO: 23) is the 3428 amino acids deduced from the nucleic acid sequence of SEQ ID NO: 24 which is drawn from residues 25902 to 36188 (sense strand) of contig 2;(SEQ ID NO: 18). The gene product of ORF 12 (SEQ ID NO: 25) is the 6751 amino acids deduced from the nucleic acid sequence of SEQ ID NO: 26 which is drawn from residues 36213 to 56468 (sense strand) of contig 2 (SEQ ID NO: 18). The gene product of ORF 13 (SEQ ID NO: 27) is the 1657 amino acids deduced from the nucleic acid sequence of SEQ ID NO: 28 which is drawn from residues 56600 to 61573 (sense strand) of contig 2 (SEQ ID NO: 18). The gene product of ORF 14 (SEQ ID NO: 29) is the 5207 amino acids deduced from the nucleic acid sequence of SEQ ID NO: 30 which is drawn from residues 61852 to 77475 (sense strand) of contig 2 (SEQ ID NO: 18). The gene product of ORF 15 (SEQ ID NO: 31) is the 5432 amino acids deduced from the nucleic acid sequence of SEQ ID NO: 32 which is drawn from residues 77606 to 93904 (sense strand) of contig 2 (SEQ ID NO: 18). The gene product of ORF 16 (SEQ ID NO: 33) is the 3227 amino acids deduced from the nucleic acid sequence of SEQ ID NO: 34 which is drawn from residues 94057 to 103740 (sense strand) of contig 2 (SEQ ID NO: 18). The gene product of ORF 17 (SEQ ID NO: 35) is the 7510 amino acids deduced from the nucleic acid sequence of SEQ ID NO: 36 which is drawn from residues 103789 to 126321 (sense strand) of contig 2 (SEQ ID NO: 18). The gene product of ORF 18 (SEQ ID NO: 37) is the 3872 amino acids deduced from the nucleic acid sequence of SEQ ID NO: 38 which is drawn from residues 126389 to 138007 (sense strand) of contig 2 (SEQ ID NO: 18). The gene product of ORF 19 (SEQ ID NO: 39) is the 338 amino acids deduced from the nucleic acid sequence of SEQ ID NO: 40 which is drawn from residues 139079 to 138063 (antisense strand) of contig 2 (SEQ ID NO: 18). The gene product of ORF 20 (SEQ ID NO: 41) is the 283 amino acids deduced from the nucleic acid sequence of SEQ ID NO: 42 which is drawn from residues 140117 to 139266 (antisense strand) of contig 2 (SEQ ID NO: 18). The gene product of ORF 21 (SEQ ID NO: 43) is the 329 amino acids deduced from the nucleic acid sequence of SEQ ID NO: 44 which is drawn from residues 141103 to 140114 (antisense strand) of contig 2 (SEQ ID NO: 18). The gene product of ORF 22 (SEQ ID NO: 45) is the 317 amino acids deduced from the nucleic acid sequence of SEQ ID NO: 46 which is drawn from residues 141483 to 142436 (sense strand) of contig 2 (SEQ ID NO: 18). The gene product of ORF 23 (SEQ ID NO: 47) is the 204 amino acids deduced from the nucleic acid sequence of SEQ ID NO: 48 which is drawn from residues 142440 to 143054 (sense strand) of contig 2 (SEQ ID NO: 18). The gene product of ORF 24 (SEQ ID NO: 49) is the 328 amino acids deduced from the nucleic acid sequence of SEQ ID NO: 50 which is drawn from residues 143133 to 144119 (sense strand) of contig 2 (SEQ ID NO: 18). The gene product of ORF 25 (SEQ ID NO: 51) is the 328 amino acids deduced from the nucleic acid sequence of SEQ ID NO: 52 which is drawn from residues 144116 to 145102 (sense strand) of contig 2 (SEQ ID NO: 18). The gene product of ORF 26 (SEQ ID NO: 53) is the 214 amino acids deduced from the nucleic acid sequence of SEQ ID NO: 54 which is drawn from residues 145099 to 145743 (sense strand) of contig 2 (SEQ ID NO: 18). The gene product of ORF 27 (SEQ ID NO: 55) is the 470 amino acids deduced from the nucleic acid sequence of SEQ ID NO: 56 which is drawn from residues 145818 to 147230 (sense strand) of contig 2 (SEQ ID NO: 18). The gene product of ORF 28 (SEQ ID NO: 57) is the 553 amino acids deduced from the nucleic acid sequence of SEQ ID NO: 58 which is drawn from residues 148967 to 147306 (antisense strand) of contig 2 (SEQ ID NO: 18). The gene product of ORF 29 (SEQ ID NO: 59) is the 231 amino acids deduced from the nucleic acid sequence of SEQ ID NO: 60 which is drawn from residues 149871 to 149176 (antisense strand) of contig 2 (SEQ ID NO: 18). The gene product of ORF 30 (SEQ ID NO: 61) is the 306 amino acids deduced from the nucleic acid sequence of SEQ ID NO: 62 which is drawn from residues 150788 to 149868 (antisense strand) of contig 2 (SEQ ID NO: 18). The gene product of ORF 31 (SEQ ID NO: 63) is the 998 amino acids deduced from the nucleic acid sequence of SEQ ID NO: 64 which is drawn from residues 153765 to 150769 (antisense strand) of contig 2 (SEQ ID NO: 18). The gene product of ORF 32 (SEQ ID NO: 65) is the 518-amino acids deduced from the nucleic acid sequence of SEQ ID NO: 66 which is drawn from residues 154485 to 156041 (sense strand) of contig 2 (SEQ ID NO: 18). The gene product of ORF 33 (SEQ ID NO: 67) is the 329 amino acids deduced from the nucleic acid sequence of SEQ ID NO: 68 which is drawn from residues 156075 to 157064 (sense strand) of contig 2 (SEQ ID NO: 18). The gene product of ORF 34 (SEQ ID NO: 69) is the 521 amino acids deduced from the nucleic acid sequence of SEQ ID NO: 70 which is drawn from residues 157308 to 158873 (sense strand) of contig 2 (SEQ ID NO: 18). The gene product of ORF 35 (SEQ ID NO: 71) is the 410 amino acids deduced from the nucleic acid sequence of SEQ ID NO: 72 which is drawn from residues 158970 to 160202 (sense strand) of contig 2 (SEQ ID NO: 18). The gene product of ORF 36 (SEQ ID NO: 73) is the 506 amino acids deduced from the nucleic acid sequence of SEQ ID NO: 74 which is drawn from residues 160199 to 161719 (sense strand) of contig 2 (SEQ ID NO: 18). The gene product of ORF 37 (SEQ ID NO: 75) is the 217 amino acids deduced from the nucleic acid sequence of SEQ ID NO: 76 which is drawn from residues 161924 to 162577 (sense strand) of contig 2 (SEQ ID NO: 18). The gene product of ORF 38 (SEQ ID NO: 77) is the 442 amino acids deduced from the nucleic acid sequence of SEQ ID NO: 78 which is drawn from residues 162723 to 164051 (sense strand) of contig 2 (SEQ ID NO: 18).

Some open reading frames listed herein initiate with non-standard initiation codons (e.g. GTG—Valine or CTG—Leucine) rather than the standard initiation codon ATG, namely ORFs 3, 5, 6, 9, 11, 13, 21, 22, 23, 24, 27, 34, 36 and 37 (SEQ ID NOS: 7, 11, 13, 20, 24, 28, 44, 46, 48, 50, 56, 70, 74 and 76). All ORFs are listed with the appropriate M, V or L amino acids at the amino-terminal position to indicate the specificity of the first codon of the ORF. It is expected, however, that in all cases the biosynthesized protein will contain a methionine residue, and more specifically a formylmethionine residue, at the amino terminal position, in keeping with the widely accepted principle that protein synthesis in bacteria initiates with methionine (formylmethionine) even when the encoding gene specifies a non-standard initiation codon (e.g. Stryer, Biochemistry 3$^{rd}$ edition, 1998, W. H. Freeman and Co., New York, pp. 752-754).

Five *E. coli* DH10B deposits, each harbouring a cosmid clone of a partial biosynthetic locus for compound 2(a) from *Streptomyces aizunensis* (NRRL B-11277) and together spanning the full locus were deposited with the International Depositary Authority of Canada, Bureau of Microbiology, Health Canada, 1015 Arlington Street, Winnipeg, Manitoba, Canada R3E 3R2 on Feb. 25, 2003 and were assigned deposit accession numbers IDAC 250203-01, IDAC 250203-02, IDAC 250203-03, IDAC 250203-04 and IDAC 250203-05 respectively. The sequence of the polynucleotides comprised in the deposited strains, as well as the amino acid sequence of any polypeptide encoded thereby are controlling in the event of any conflict with any description of sequences herein.

A natural mutant of *Streptomyces aizunensis* (NRRL B-11277), referred to as strain [C03]023 producing Compound 2(a) and used to produce the compounds of Formula I and Formula II was deposited with the International Depositary Authority of Canada, Bureau of Microbiology, Health Canada, 1015 Arlington Street, Winnipeg, Manitoba, Canada R3E 3R2 on Aug. 7, 2003 and was assigned deposit accession number IDAC 070803-1.

Another mutant of *Streptomyces aizunensis* (NRRL B-11277), referred to as strain [C03U03]023 producing Compound 2(a) and used to produce the compounds of Formula I and Formula II was deposited with the International Depositary Authority of Canada, Bureau of Microbiology, Health Canada, 1015 Arlington Street, Winnipeg, Manitoba, Canada R3E 3R2 on Dec. 23, 2003 and was assigned deposit accession number IDAC 231203-02.

The deposited cosmids and strains [C03]023 and [C03U03]023 (the deposited stains) have been made under the terms of the Budapest Treaty on the International Recognition of the Deposit of Micro-organisms for Purposes of Patent Procedure. The deposited strains will be irrevocably and without restriction or condition released to the public upon the issuance of a patent. A license may be required to make, use or sell the deposited strains, and compounds derived there from, and no such license is hereby granted.

The order and relative position of the 38 open reading frames representing the proteins of the biosynthetic locus for compound 2(a) (compound 2(a) ORFs) are illustrated schematically in FIG. 1. The top line in FIG. 1 provides a scale in base pairs. The gray bars depict the two DNA contigs that cover the compound 2(a) locus. The empty arrows represent the 38 open reading frames of the compound 2(a) biosynthetic locus. The black arrows represent the five deposited cosmid clones covering the entire compound 2(a) locus.

One aspect of the present invention is an isolated, purified, or enriched nucleic acid comprising one of the sequences of SEQ ID NOS: 3, 5, 7, 9, 11, 13, 15, 17, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, the sequences complementary thereto, or a fragment comprising at least 100, 200, 300, 400, 500, 600, 700, 800 or more consecutive bases of one of the sequences of SEQ ID NOS: 3, 5, 7, 9, 11, 13, 15, 17, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78 or the sequences complementary thereto. The isolated, purified or enriched nucleic acids may comprise DNA, including cDNA, genomic DNA, and synthetic DNA. The DNA may be double stranded or single stranded, and if single stranded may be the coding (sense) or non-coding (anti-sense) strand. Alternatively, the isolated, purified or enriched nucleic acids may comprise RNA.

As discussed in more detail below, the isolated, purified or enriched nucleic acids of one of SEQ ID NOS: 3, 5, 7, 9, 11, 13, 15, 17, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78 may be used to prepare one of the polypeptides of SEQ ID NOS: 2, 4, 6, 8, 10, 12, 14, 16, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, respectively, or fragments comprising at least 50, 75, 100, 200, 300, 500 or more consecutive amino acids of one of the polypeptides of SEQ ID NO: 2, 4, 6, 8, 10, 12, 14, 16, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77.

Accordingly, another aspect of the present invention is an isolated, purified or enriched nucleic acid which encodes one of the polypeptides of SEQ ID NOS: 2, 4, 6, 8, 10, 12, 14, 16, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77 or fragments comprising at least 50, 75, 100, 150, 200, 300 or more consecutive amino acids of one of the polypeptides of SEQ ID NOS: 2, 4, 6, 8, 10, 12, 14, 16, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77. The coding sequences of these nucleic acids may be identical to one of the coding sequences of one of the nucleic acids of SEQ ID NOS: 3, 5, 7, 9, 11, 13, 15, 17, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78 or a fragment thereof, or may be different coding sequences which encode one of the polypeptides of SEQ ID NOS: 2, 4, 6, 8, 10, 12, 14, 16, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77 or fragments comprising at least 50, 75, 100, 150, 200, 300 consecutive amino acids of one of the polypeptides of SEQ ID NOS: 2, 4, 6, 8, 10, 12, 14, 16, 19, 21, 23, 25, 27, 29, 31, 33, 35, 37, 39, 41 43, 45, 47, 49, 51, 53, 55, 57, 59, 61, 63, 65, 67, 69, 71, 73, 75, 77 as a result of the redundancy or degeneracy of the genetic code. The genetic code is well known to those of skill in the art and can be obtained, for example, from Stryer, *Biochemistry*, 3$^{rd}$ edition, W. H. Freeman & Co., New York.

The isolated, purified or enriched nucleic acid which encodes one of the polypeptides of SEQ ID NOS: 2, 4, 6, 8, 10, 12, 14, 16, 19, 21, 23, 25, 27, 29, 31, 33, 35, 37, 39, 41, 43, 45, 47, 49, 51, 53,.55, 57, 59, 61, 63, 65, 67, 69, 71, 73, 75, 77 may include, but is not limited to: (1) only the coding sequences of one of SEQ ID NOS: 3, 5, 7, 9, 11, 13, 15, 17, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78; (2) the coding sequences of SEQ ID NOS: 3, 5, 7, 9, 11, 13, 15, 17, 20, 22, 24, 26, 28, 30, 32, 34, 36, 38, 40, 42, 44, 46, 48, 50, 52, 54, 56, 58, 60, 62, 64; 66, 68, 70, 72, 74, 76, 78 and additional coding sequences, such as leader sequences or proprotein; and (3) the coding sequences of SEQ ID NOS: 3, 5, 7, 9, 11, 13, 15, 17, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78 and non-coding sequences, such as non-coding sequences 5' and/or 3' of the coding sequence. Thus, as used herein, the term "polynucleotide encoding a polypeptide" encompasses a polynucleotide that includes only coding sequence for the polypeptide as well as a polynucleotide that includes additional coding and/or non-coding sequence.

The invention relates to polynucleotides based on SEQ ID NOS: 3, 5, 7, 9, 11, 13, 15, 17, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78 but having polynucleotide changes that are "silent", for example changes which do not alter the amino acid sequence encoded by the polynucleotides of SEQ ID NOS: 3, 5, 7, 9, 11, 13, 15, 17, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78. The invention also relates to polynucleotides which have nucleotide changes which result in amino acid substitutions, additions, deletions, fusions and truncations of the polypeptides of SEQ ID NOS: 2, 4, 6, 8, 10, 12, 14, 16, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77. Such nucleotide changes may be introduced using techniques such as site directed mutagenesis, random chemical mutagenesis, exonuclease III deletion, and other recombinant DNA techniques.

The isolated, purified or enriched nucleic acids of SEQ ID NOS: 3, 5, 7, 9, 11, 13, 15, 17, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, the sequences complementary thereto, or a fragment comprising at least 10, 15, 20, 25, 30, 35, 40, 50, 75, 100, 150, 200, 300, 400 or 500 consecutive bases of one of the sequence of SEQ ID NOS: 3, 5, 7, 9, 11, 13, 15, 17, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, or the sequences complementary thereto may be used as probes to identify and isolate DNAs encoding the polypeptides of SEQ ID NOS: 2, 4, 6, 8, 10, 12, 14, 16, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77 respectively. In such procedures, a genomic DNA library is constructed from a sample microorganism or a sample containing a microorganism capable of producing a polyketide. The genomic DNA library is then contacted with a probe comprising a coding sequence or a fragment of the coding sequence, encoding one of the polypeptides of SEQ ID NOS: 2, 4, 6, 8, 10, 12, 14, 16, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, or a fragment thereof under conditions which permit the probe to specifically hybridize to sequences complementary thereto. In a preferred embodiment, the probe is an oligonucleotide of about 10 to about 30 nucleotides in length designed based on a nucleic acid of SEQ ID NOS: 3, 5, 7, 9, 11, 13, 15, 17, 20, 22, 24, 26, 28, 30, 32, 34, 36, 38, 40, 42, 44, 46, 48, 50, 52, 54, 56, 58, 60, 62, 64, 66, 68, 70, 72, 74, 76 or 78. Genomic DNA clones which hybridize to the probe are then detected and isolated. Procedures for preparing and identifying DNA clones of interest are disclosed in Ausubel et al., Current Protocols in Molecular Biology, John Wiley 503 Sons, Inc. 1997; and Sambrook et al., Molecular Cloning: A Laboratory Manual 2d Ed., Cold Spring Harbor Laboratory Press, 1989. In another embodiment, the probe is a restriction fragment or a PCR amplified nucleic acid derived from SEQ ID NOS: 3, 5, 7, 9, 11, 13, 15, 17, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78.

The isolated, purified or enriched nucleic acids of SEQ ID NOS: 3, 5, 7, 9, 11, 13, 15, 17, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, the sequences complementary thereto, or a fragment comprising at least 10, 15, 20, 25, 30, 35, 40, 50, 75, 100, 150, 200, 300, 400 or 500 consecutive bases of one of the sequences of SEQ ID NOS: 3, 5, 7, 9, 11, 13, 15, 17, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, or the sequences complementary thereto may be used as probes to identify and isolate related nucleic acids. In some embodiments, the related nucleic acids may be genomic DNAs (or cDNAs) from potential polyketide producers. In such procedures, a nucleic acid sample containing nucleic acids from a potential polyketide producer is contacted with the probe under conditions that permit the probe to specifically hybridize to related sequences. The nucleic acid sample may be a genomic DNA (or cDNA) library from the potential polyketide producer. Hybridization of the probe to nucleic acids is then detected using any of the methods described above.

Hybridization may be carried out under conditions of low stringency, moderate stringency or high stringency. As an example of nucleic acid hybridization, a polymer membrane containing immobilized denatured nucleic acids is first prehybridized for 30 minutes at 45° C. in a solution consisting of 0.9 M NaCl, 50 mM $NaH_2PO_4$, pH 7.0, 5.0 mM $Na_2EDTA$, 0.5% SDS, 10× Denhardt's, and 0.5 mg/ml polyriboadenylic acid. Approximately $2×10^7$ cpm (specific activity $4-9×10^8$ cpm/ug) of $^{32}P$ end-labeled oligonucleotide probe are then added to the solution. After 12-16 hours of incubation, the membrane is washed for 30 minutes at room temperature in 1× SET (150 mM NaCl, 20 mM Tris hydrochloride, pH 7.8, 1 mM $Na_2EDTA$) containing 0.5% SDS, followed by a 30 minute wash in fresh 1× SET at Tm-10° C. for the oligonucleotide probe where Tm is the melting temperature. The membrane is then exposed to autoradiographic film for detection of hybridization signals.

By varying the stringency of the hybridization conditions used to identify nucleic acids, such as genomic DNAs or cDNAs, which hybridize to the detectable probe, nucleic acids having different levels of homology to the probe can be identified and isolated. Stringency may be varied by conducting the hybridization at varying temperatures below the melting temperatures of the probes. The melting temperature of the probe may be calculated using the following formulas:

For oligonucleotide probes between 14 and 70 nucleotides in length the melting temperature (Tm) in degrees Celcius may be calculated using the formula: Tm=81.5+16.6(log [Na+])+0.41 (fraction G+C)−(600/N) where N is the length of the oligonucleotide.

If the hybridization is carried out in a solution containing formamide, the melting temperature may be calculated using the equation Tm=81.5+16.6(log [Na+])+0.41 (fraction G+C)−(0.63% formamide)−(600/N) where N is the length of the probe.

Prehybridization may be carried out in 6×SSC, 5× Denhardt's reagent, 0.5% SDS, 0.1 mg/ml denatured fragmented salmon sperm DNA or 6×SSC, 5× Denhardt's reagent, 0.5% SDS, 0.1 mg/ml denatured fragmented salmon sperm DNA, 50% formamide. The composition of the SSC and Denhardt's solutions are listed in Sambrook et al., supra.

Hybridization is conducted by adding the detectable probe to the hybridization solutions listed above. Where the probe comprises double stranded DNA, it is denatured by incubating at elevated temperatures and quickly cooling before addition to the hybridization solution. It may also be desirable to similarly denature single stranded probes to eliminate or diminish formation of secondary structures or oligomerization. The filter is contacted with the hybridization solution for a sufficient period of time to allow the probe to hybridize to cDNAs or genomic DNAs containing sequences complementary thereto or homologous thereto. For probes over 200 nucleotides in length, the hybridization may be carried out at 15-25° C. below the Tm. For shorter probes, such as oligonucleotide probes, the hybridization may be conducted at 5-10° C. below the Tm. Preferably, the hybridization is conducted in 6xSSC, for shorter probes. Preferably, the hybridization is conducted in 50% formamide containing solutions, for longer probes. All the foregoing hybridizations would be considered to be examples of hybridization performed under conditions of high stringency.

Following hybridization, the filter is washed for at least 15 minutes in 2xSSC, 0.1% SDS at room temperature or higher, depending on the desired stringency. The filter is then washed with 0.1xSSC, 0.5% SDS at room temperature (again) for 30 minutes to 1 hour. Nucleic acids which have hybridized to the probe are identified by conventional autoradiography and non-radioactive detection methods.

The above procedure may be modified to identify nucleic acids having decreasing levels of homology to the probe sequence. For example, to obtain nucleic acids of decreasing homology to the detectable probe, less stringent conditions may be used. For example, the hybridization temperature may be decreased in increments of 5° C. from 68° C. to 42° C. in a hybridization buffer having a Na+ concentration of approximately 1 M. Following hybridization, the filter may be washed with 2xSSC, 0.5% SDS at the temperature of hybridization. These conditions are considered to be "moderate stringency" conditions above 50° C. and "low stringency" conditions below 50° C. A specific example of "moderate stringency" hybridization conditions is when the above hybridization is conducted at 55° C. A specific example of "low stringency" hybridization conditions is when the above hybridization is conducted at 45° C.

Alternatively, the hybridization may be carried out in buffers, such as 6xSSC, containing formamide at a temperature of 42° C. In this case, the concentration of formamide in the hybridization buffer may be reduced in 5% increments from 50% to 0% to identify clones having decreasing levels of homology to the probe. Following hybridization, the filter may be washed with 6xSSC, 0.5% SDS at 50° C. These conditions are considered to be "moderate stringency" conditions above 25% formamide and "low stringency" conditions below 25% formamide. A specific example of "moderate stringency" hybridization conditions is when the above hybridization is conducted at 30% formamide. A specific example of "low stringency" hybridization conditions is when the above hybridization is conducted at 10% formamide. Nucleic acids which have hybridized to the probe are identified by conventional autoradiography and non-radioactive detection methods.

The preceding methods may be used to isolate nucleic acids having at least 97%, at least 95%, at least 90%, at least 85%, at least 80%, or at least 70% sequence identity to a nucleic acid sequence selected from the group consisting of the sequences of SEQ ID NOS: 3, 5, 7, 9, 11, 13, 15, 17, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, fragments comprising at least 10, 15, 20, 25, 30, 35, 40, 50, 75, 100, 150, 200, 300, 400, or 500 consecutive bases thereof, and the sequences complementary thereto. The isolated nucleic acid may have a coding sequence that is a naturally occurring allelic variant of one of the coding sequences described herein. Such allelic variant may have a substitution, deletion or addition of one or more nucleotides when compared to the nucleic acids of SEQ ID NOS: 3, 5, 7, 9, 11, 13, 15, 17, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, or the sequences complementary thereto.

Additionally, the above procedures may be used to isolate nucleic acids which encode polypeptides having at least 99%, at least 95%, at least 90%, at least 85%, at least 80%, or at least 70% identity to a polypeptide having the sequence of one of SEQ ID NOS: 2, 4, 6, 8, 10, 12, 14, 16, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77 or fragments comprising at least 50, 75, 100, 150, 200, 300 consecutive amino acids thereof as determined using the BLASTP version 2.2.2 algorithm with default parameters.

Another aspect of the present invention is an isolated or purified polypeptide comprising the sequence of one of SEQ ID NOS: 2, 4, 6, 8, 10, 12, 14, 16, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77 or fragments comprising at least 50, 75, 100, 150, 200 or 300 consecutive amino acids thereof. As discussed herein, such polypeptides may be obtained by inserting a nucleic acid encoding the polypeptide into a vector such that the coding sequence is operably linked to a sequence capable of driving the expression of the encoded polypeptide in a suitable host cell. For example, the expression vector may comprise a promoter, a ribosome binding site for translation initiation and a transcription terminator. The vector may also include appropriate sequences for modulating expression levels, an origin of replication and a selectable marker.

Promoters suitable for expressing the polypeptide or fragment thereof in bacteria include the *E. coli* lac or trp promoters, the lad promoter, the lacZ promoter, the T3 promoter, the T7 promoter, the gpt promoter, the lambda $P_R$ promoter, the lambda $P_L$ promoter, promoters from operons encoding glycolytic enzymes such as 3-phosphoglycerate kinase (PGK), and the acid phosphatase promoter. Fungal promoters include the α factor promoter. Eukaryotic promoters include the CMV immediate early promoter, the HSV thymidine kinase promoter, heat shock promoters, the early and late SV40 promoter, LTRs from retroviruses, and the mouse metallothionein-I promoter. Other promoters known to control expression of genes in prokaryotic or eukaryotic cells or their viruses may also be used.

Mammalian expression vectors may also comprise an origin of replication, any necessary ribosome binding sites, a polyadenylation site, splice donors and acceptor sites, transcriptional termination sequences, and 5' flanking nontranscribed sequences. In some embodiments, DNA sequences derived from the SV40 splice and polyadenylation sites may be used to provide the required nontranscribed genetic elements.

Vectors for expressing the polypeptide or fragment thereof in eukaryotic cells may also contain enhancers to increase expression levels. Enhancers are cis-acting elements of DNA, usually from about 10 to about 300 bp in length that act on a promoter to increase its transcription. Examples include the SV40 enhancer on the late side of the replication origin bp 100 to 270, the cytomegalovirus early promoter enhancer, the polyoma enhancer on the late side of the replication origin, and the adenovirus enhancers.

In addition, the expression vectors preferably contain one or more selectable marker genes to permit selection of host cells containing the vector. Examples of selectable markers that may be used include genes encoding dihydrofolate reductase or genes conferring neomycin resistance for eukaryotic cell culture, genes conferring tetracycline or ampicillin resistance in *E. coli*, and the *S. cerevisiae* TRP1 gene.

In some embodiments, the nucleic acid encoding one of the polypeptides of SEQ ID NOS: 2, 4, 6, 8, 10, 12, 14, 16, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77 or fragments comprising at least 50, 75, 100, 150, 200 or 300 consecutive amino acids thereof is assembled in appropriate phase with a leader sequence capable of directing secretion of the translated polypeptides or fragments thereof. Optionally, the nucleic acid can encode a fusion polypeptide in which one of the polypeptide of SEQ ID NOS: 2, 4, 6, 8, 10, 12, 14, 16, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77 or fragments comprising at least 5, 10, 15, 20, 25, 30, 35, 40, 50, 75, 100, or 150 consecutive amino acids thereof is fused to heterologbus peptides or polypeptides, such as N-terminal identification peptides which impart desired characteristics such as increased stability or simplified purification or detection.

The appropriate DNA sequence may be inserted into the vector by a variety of procedures. In general, the DNA sequence is ligated to the desired position in the vector following digestion of the insert and the vector with appropriate restriction endonucleases. Alternatively, appropriate restriction enzyme sites can be engineered into a DNA sequence by PCR. A variety of cloning techniques are disclosed in Ausbel et al. Current Protocols in Molecular Biology, John Wiley 503 Sons, Inc. 1997 and Sambrook et al., Molecular Cloning: A Laboratory Manual 2d Ed., Cold Spring Harbour Laboratory Press, 1989. Such procedures and others are deemed to be within the scope of those skilled in the art.

The vector may be, for example, in the form of a plasmid, a viral particle, or a phage. Other vectors include derivatives of chromosomal, nonbchromosomal and synthetic DNA sequences, viruses, bacterial plasmids, phage DNA, baculovirus, yeast plasmids, vectors derived from combinations of plasmids and phage DNA, viral DNA such as vaccinia, adenovirus, fowl pox virus, and pseudorabies. A variety of cloning and expression vectors for use with prokaryotic and eukaryotic hosts are described by Sambrook et al., Molecular Cloning: A Laboratory Manual, Second Edition, Cold Spring Harbor, N.Y., (1989).

Particular bacterial vectors which may be used include the commercially available plasmids comprising genetic elements of the well known cloning vector pBR322 (ATCC 37017), pKK223-3 (Pharmacia Fine Chemicals, Uppsala, Sweden), pGEM1 (Promega Biotec, Madison, Wis., USA) pQE70, pQE60, pQE-9 (Qiagen), pD10, phiX174, pBluescript™ II KS, pNH8A, pNH16a, pNH18A, pNH46A (Stratagene), ptrc99a, pKK223-3, pKK233-3, pDR540, pRIT5 (Pharmacia), pKK232-8 and pCM7. Particular eukaryotic vectors include pSV2CAT, pOG44, pXT1, pSG (Stratagene) pSVK3, pBPV, pMSG, and pSVL (Pharmacia). However, any other vector may be used as long as it is replicable and stable in the host cell.

The host cell may be any of the host cells familiar to those skilled in the art, including prokaryotic cells or eukaryotic cells. As representative examples of appropriate hosts, there may be mentioned: bacteria cells, such as E. coli, Streptomyces lividans, Streptomyces griseofuscus, Streptomyces ambofaciens, Bacillus subtilis, Salmonella typhimurium and various species within the genera Pseudomonas, Streptomyces, Bacillus, and Staphylococcus, fungal cells, such as yeast, insect cells such as Drosophila S2 and Spodoptera Sf9, animal cells such as CHO, COS or Bowes melanoma, and adenoviruses. The selection of an appropriate host is within the abilities of those skilled in the art.

The vector may be introduced into the host cells using any of a variety of techniques, including electroporation transformation, transfection, transduction, viral infection, gene guns, or Ti-mediated gene transfer. Where appropriate, the engineered host cells can be cultured in conventional nutrient media modified as appropriate for activating promoters, selecting transformants or amplifying the genes of the present invention. Following transformation of a suitable host strain and growth of the host strain to an appropriate cell density, the selected promoter may be induced by appropriate means (e.g., temperature shift or chemical induction) and the cells may be cultured for an additional period to allow them to produce the desired polypeptide or fragment thereof.

Cells are typically harvested by centrifugation, disrupted by physical or chemical means, and the resulting crude extract is retained for further purification. Microbial cells employed for expression of proteins can be disrupted by any convenient method, including freeze-thaw cycling, sonication, mechanical disruption, or use of cell lysing agents. Such methods are well known to those skilled in the art. The expressed polypeptide or fragment thereof can be recovered and purified from recombinant cell cultures by methods including ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography. Protein refolding steps can be used, as necessary, in completing configuration of the polypeptide. If desired, high performance liquid chromatography (HPLC) can be employed for final purification steps.

Various mammalian cell culture systems can also be employed to express recombinant protein. Examples of mammalian expression systems include the COS-7 lines of monkey kidney fibroblasts (described by Gluzman, Cell, 23:175(1981)), and other cell lines capable of expressing proteins from a compatible vector, such as the C127, 3T3, CHO, HeLa and BHK cell lines. The constructs in host cells can be used in a conventional manner to produce the gene product encoded by the recombinant sequence. Polypeptides of the invention may or may not also include an initial methionine amino acid residue.

Alternatively, the polypeptides of SEQ ID NOS: 2, 4, 6, 8, 10, 12, 14, 16, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77 or fragments comprising at least 50, 75, 100, 150, 200 or 300 consecutive amino acids thereof can be synthetically produced by conventional peptide synthesizers. In other embodiments, fragments or portions of the polynucleotides may be employed for producing the corresponding full-length polypeptide by peptide synthesis; therefore, the fragments may be employed as intermediates for producing the full-length polypeptides.

Cell-free translation systems can also be employed to produce one of the polypeptides of SEQ ID NOS: 2, 4, 6, 8, 10, 12, 14, 16, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77 or fragments comprising at least 50, 75, 100, 150, 200 or 300 consecutive amino acids thereof using mRNAs transcribed from a DNA construct comprising a promoter operably linked to a nucleic acid encoding the polypeptide or fragment thereof. In some embodiments, the DNA construct may be linearized prior to conducting an in vitro transcription reaction. The transcribed mRNA is then incubated with an appropriate cell-free translation extract, such as a rabbit reticulocyte extract, to produce the desired polypeptide or fragment thereof.

The present invention also relates to variants of the polypeptides of SEQ ID NOS: 2, 4, 6, 8, 10, 12, 14, 16, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77 or fragments comprising at least 50, 75, 100, 150, 200 or 300 consecutive amino acids thereof. The term "variant" includes derivatives or analogs of these polypeptides. In particular, the variants may differ in amino acid sequence from the polypeptides of SEQ ID NOS: 2, 4, 6, 8, 10, 12, 14, 16, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77 by one or more substitutions, additions, deletions, fusions and truncations, which may be present in any combination.

The variants may be naturally occurring or created in vitro. In particular, such variants may be created using genetic engineering techniques such as site directed mutagenesis, random chemical mutagenesis, exonuclease III deletion procedures, and standard cloning techniques. Alternatively, such variants, fragments, analogs, or derivatives may be created using chemical synthesis or modification procedures.

Other methods of making variants are also familiar to those skilled in the art. These include procedures in which nucleic acid sequences obtained from natural isolates are modified to generate nucleic acids that encode polypeptides having characteristics which enhance their value in industrial or laboratory applications. In such procedures, a large number of variant sequences having one or more nucleotide differences with respect to the sequence obtained from the natural isolate are generated and characterized. Preferably, these nucleotide differences result in amino acid changes with respect to the polypeptides encoded by the nucleic acids from the natural isolates.

For example, variants may be created using error prone PCR. In error prone PCR, DNA amplification is performed under conditions where the fidelity of the DNA polymerase is low, such that a high rate of point mutation is obtained along the entire length of the PCR product. Error prone PCR is described in Leung, D. W., et al., Technique, 1:11-15 (1989) and Caldwell, R. C. & Joyce G. F., PCR Methods Applic., 2:28-33 (1992). Variants may also be created using site directed mutagenesis to generate site-specific mutations in any cloned DNA segment of interest. Oligonucleotide mutagenesis is described in Reidhaar-Olson, J. F. & Sauer, R. T., et al., Science, 241:53-57 (1988). Variants may also be created using directed evolution strategies such as those described in U.S. Pat. Nos. 6,361,974 and 6,372,497. The variants of the polypeptides of SEQ ID NOS: 2, 4, 6, 8, 10, 12, 14, 16, 19, 21, 23, 25, 27, 29, 31, 33, 35, 37, 39, 41, 43, 45, 47, 49, 51, 53, 55, 57, 59, 61, 63, 65, 67, 69, 71, 73, 75 and 77 may be variants in which one or more of the amino acid residues of the polypeptides of SEQ ID NOS: 2, 4, 6, 8, 10, 12, 14, 16, 19, 21, 23, 25, 27, 29, 31, 33, 35, 37, 39, 41, 43, 45, 47, 49, 51, 53, 55, 57, 59, 61, 63, 65, 67, 69, 71, 73, 75 or 77 are substituted with a conserved or non-conserved amino acid residue (preferably a conserved amino acid residue) and such substituted amino acid residue may or may not be one encoded by the genetic code.

Conservative substitutions are those that substitute a given amino acid in a polypeptide by another amino acid of like characteristics. Typically seen as conservative substitutions are the following replacements: replacements of an aliphatic amino acid such as Ala, Val, Leu and Ile with another aliphatic amino acid; replacement of a Ser with a Thr or vice versa; replacement of an acidic residue such as Asp or Glu with another acidic residue; replacement of a residue bearing an amide group, such as Asn or Gln, with another residue bearing an amide group; exchange of a basic residue such as Lys or Arg with another basic residue; and replacement of an aromatic residue such as Phe or Tyr with another aromatic residue.

Other variants are those in which one or more of the amino acid residues of the polypeptides of SEQ ID NOS: 2, 4, 6, 8, 10, 12, 14, 16, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77 include a substituent group. Still other variants are those in which the polypeptide is associated with another compound, such as a compound to increase the half-life of the polypeptide (for example, polyethylene glycol). Additional variants are those in which additional amino acids are fused to the polypeptide, such as leader sequence, a secretory sequence, a proprotein sequence or a sequence that facilitates purification, enrichment, or stabilization of the polypeptide.

In some embodiments, the fragments, derivatives and analogs retain the same biological function or activity as the polypeptides of SEQ ID NOS: 2, 4, 6, 8, 10, 12, 14, 16, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77. In other embodiments, the fragment, derivative or analogue includes a fused heterologous sequence that facilitates purification, enrichment, detection, stabilization or secretion of the polypeptide that can be enzymatically cleaved, in whole or in part, away from the fragment, derivative or analogue.

Another aspect of the present invention are polypeptides or fragments thereof which have at least 70%, at least 80%, at least 85%, at least 90%, or more than 95% identity to one of the polypeptides of SEQ ID NOS: 2, 4, 6, 8, 10, 12, 14, 16, 19, 21, 23, 25, 27, 29, 31, 33, 35, 37, 39, 41, 43, 45, 47, 49, 51, 53, 55, 57, 59, 61, 63, 65, 67, 69, 71, 73, 75 and 77 or a fragment comprising at least 50, 75, 100, 150, 200 or 300 consecutive amino acids thereof. It will be appreciated that amino acid "identity" includes conservative substitutions such as those described above.

The polypeptides or fragments having homology to one of the polypeptides of SEQ ID NOS: 2, 4, 6, 8, 10, 12, 14, 16, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77 or a fragment comprising at least 50, 75, 100, 150, 200 or 300 consecutive amino acids thereof may be obtained by isolating the nucleic acids encoding them using the techniques described above.

Alternatively, the homologous polypeptides or fragments may be obtained through biochemical enrichment or purification procedures. The sequence of potentially homologous polypeptides or fragments may be determined by proteoiytic digestion, gel electrophoresis and/or microsequencing. The sequence of the prospective homologous polypeptide or fragment can be compared to one of the polypeptides of SEQ ID NOS: 2, 4, 6, 8, 10, 12, 14, 16, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77 or a fragment comprising at least 5, 10, 15, 20, 25, 30, 35, 40, 50, 75, 100, or 150 consecutive amino acids thereof.

The polypeptides of SEQ ID NOS: 2, 4, 6, 8, 10, 12, 14, 16, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77 or fragments, derivatives or analogs thereof comprising at least 40, 50, 75, 100, 150, 200 or 300 consecutive amino acids thereof invention may be used in a variety of applications. For example, the polypeptides or fragments, derivatives or analogs thereof may be used to catalyze biochemical reactions as described elsewhere in the specification.

The polypeptides of SEQ ID NOS: 2, 4, 6, 8, 10, 12, 14, 16, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77 or fragments, derivatives or analogues thereof comprising at least 5, 10, 15, 20, 25, 30, 35, 40, 50, 75, 100, or 150 consecutive amino acids thereof, may also be used to generate antibodies which bind specifically to the polypeptides or fragments, derivatives or analogues. The antibodies generated from SEQ ID NOS: 2, 4, 6, 8, 10, 12, 14, 16, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77 may be used to determine whether a biological sample contains *Streptomyces aizunensis* or a related microorganism.

In such procedures, a biological sample is contacted with an antibody capable of specifically binding to one of the polypeptides of SEQ ID NOS: 2, 4, 6, 8, 10, 12, 14, 16, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77 or fragments comprising at least 5, 10, 15, 20, 25, 30, 35, 40, 50, 75, 100, or 150 consecutive amino acids thereof. The ability of the biological sample to bind to the antibody is then determined. For example, binding may be determined by labeling the antibody with a detectable label such as a fluorescent agent, an enzymatic label, or a radioisotope. Alternatively, binding of the antibody to the sample may be detected using a secondary antibody having such a detectable label thereon. A variety of assay protocols which may be used to detect the presence of a polyketide-producer or of *Streptomyces aizunensis* or of polypeptides related to SEQ ID NOS: 2, 4, 6, 8, 10, 12, 14, 16, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77 in a sample are familiar to those skilled in the art. Particular assays include ELISA assays, sandwich assays, radioimmunoassays, and Western Blots. Alternatively, antibodies generated from SEQ ID NOS: 2, 4, 6, 8, 10, 12, 14, 16, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77 may be used to determine whether a biological sample contains related polypeptides that may be involved in the biosynthesis of polyketides.

Polyclonal antibodies generated against the polypeptides of SEQ ID NOS: 2, 4, 6, 8, 10, 12, 14, 16, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77 or fragments comprising at least 5, 10, 15, 20, 25, 30, 35, 40, 50, 75, 100, or 150 consecutive amino acids thereof can be obtained by direct injection of the polypeptides into an animal or by administering the polypeptides to an animal, preferably a nonhuman. The antibody so obtained will then bind the polypeptide itself. In this manner, even a sequence encoding only a fragment of the polypeptide can be used to generate antibodies that may bind to the whole native polypeptide. Such antibodies can then be used to isolate the polypeptide from cells expressing that polypeptide.

For preparation of monoclonal antibodies, any technique that provides antibodies produced by continuous cell line cultures can be used. Examples include the hybridoma technique (Kholer and Milstein, 1975, Nature, 256:495-497), the trioma technique, the human B-cell hybridoma technique (Kozbor et al., 1983, Immunology Today 4:72), and the EBV-hybridoma technique (Cole, et al., 1985, in Monoclonal Antibodies and Cancer Therapy, Alan R. Liss, Inc., pp. 77-96).

Techniques described for the production of single chain antibodies (U.S. Pat. No. 4,946,778) can be adapted to produce single chain antibodies to the polypeptides of SEQ ID NOS: 2, 4, 6, 8, 10, 12, 14, 16, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77 or fragments comprising at least 5, 10, 15, 20, 25, 30, 35, 40, 50, 75, 100, or 150 consecutive amino acids thereof. Alternatively, transgenic mice may be used to express humanized antibodies to these polypeptides or fragments thereof.

Antibodies generated against the polypeptides of SEQ ID NOS: 2, 4, 6, 8, 10, 12, 14, 16, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77 or fragments comprising at least 5, 10, 15, 20, 25, 30, 35, 40, 50, 75, 100, or 150 consecutive amino acids thereof may be used in screening for similar polypeptides from a sample containing organisms or cell-free extracts thereof. In such techniques, polypeptides from the sample are contacted with the antibodies and those polypeptides which specifically bind the antibody are detected. Any of the procedures described above may be used to detect antibody binding. One such screening assay is described in "Methods for measuring Cellulase Activities", Methods in Enzymology, Vol 160, pp. 87-116.

In order to identify the function of the genes in the compound 2(a) locus, ORFs 1 to 38 were compared, using the BLASTP version 2.2.1 algorithm with the default parameters, to sequences in the National Center for Biotechnology Information (NCBI) nonredundant protein database and the DECIPHER® database of microbial genes, pathways and natural products (Ecopia BioSciences Inc. St. Laurent, QC, Canada).

The accession numbers of the top GenBank hits of this Blast analysis are presented in Table 1 along with the corresponding E values. The E value relates the expected number of chance alignments with an alignment score at least equal to the observed alignment score. An E value of 0.00 indicates a perfect homolog. The E values are calculated as described in Altschul et al. *J. Mol. Biol.*, 215, 403-410 (1990). The E value assists in the determination of whether two sequences display sufficient similarity to justify an inference of homology.

TABLE 1

| ORF | Family | #aa | GenBank homology | probability | % identity | % similarity | proposed function of GenBank match |
|---|---|---|---|---|---|---|---|
| 1 | | 719 | T35189, 719aa | 1E-200 | 556/705 (78.7%) | 582/705 (82.55%) | helicase, *Streptomyces coelicolor* |
| | | | BAC17778.1, 686aa | 1E-165 | 340/700 (48.57%) | 407/700 (58.14%) | helicase, *Corynebacterium efficiens* |
| | | | NP_600121.1, 683aa | 1E-161 | 334/701 (47.65%) | 412/701 (58.77%) | helicase, *Corynebacterium glutamicum* |
| 2 | TESA | 253 | BAB69315.1, 255aa | 2E-82 | 142/243 (58.44%) | 185/243 (76.13%) | thioesterase, *Streptomyces avermitilis* |
| | | | CAC20922.1, 255aa | 3E-78 | 145/247 (58.7%) | 180/247 (72.87%) | PimI thioesterase, *Streptomyces natalensis* |

TABLE 1-continued

| ORF | Family | #aa | GenBank homology | probability | % identity | % similarity | proposed function of GenBank match |
|---|---|---|---|---|---|---|---|
| | | | AAF71777.1, 251aa | 2E-73 | 135/244 (55.33%) | 173/244 (70.9%) | NysE thioesterase, *Streptomyces noursei* |
| 3 | REGD | 956 | AAC68887.1, 928aa | 1E-132 | 336/959 (35.04%) | 472/959 (49.22%) | transcriptional activator, *Streptomyces venezuelae* |
| | | | AAM88362.1, 945aa | 1E-131 | 331/957 (34.59%) | 468/957 (48.9%) | NbmM regulator, *Streptomyces narbonensis* |
| | | | BAA84600.1, 949aa | 1E-127 | 339/965 (35.13%) | 451/965 (46.74%) | response regulator, *Streptomyces avermitilis* |
| 4 | RREB | 201 | NP_629592.1, 224aa | 8E-49 | 106/204 (51.96%) | 140/204 (68.63%) | response regulator, *Streptomyces coelicolor* |
| | | | CAA74720.1, 217aa | 8E-47 | 100/202 (49.5%) | 138/202 (68.32%) | response regulator, *Streptomyces reticuli* |
| | | | NP_642485.1, 213aa | 1E-43 | 96/201 (47.76%) | 132/201 (65.67%) | regulator, *Xanthomonas axonopodis* |
| 5 | SPKK | 416 | NP_628447.1, 428aa | 7E-39 | 116/312 (37.18%) | 163/312 (52.24%) | kinase, *Streptomyces coelicolor* |
| | | | CAA74719.1, 398aa | 2E-37 | 113/304 (37.17%) | 157/304 (51.64%) | kinase, *Streptomyces reticuli* |
| | | | CAC32293.1, 404aa | 6E-37 | 109/267 (40.82%) | 139/267 (52.06%) | kinase, *Streptomyces coelicolor* |
| 6 | UNEW | 186 | NP_628531.1, 185aa | 0.002 | 30/102 (29.41%) | 50/102 (49.02%) | membrane protein, *Streptomyces coelicolor* |
| 7 | UNFI | 163 | CAB10923.1, 177aa | 2E-27 | 67/162 (41.36%) | 97/162 (59.88%) | hypothetical protein, *Mycobacterium tuberculosis* |
| | | | ZP_00059442.1, 172aa | 4E-24 | 66/177 (37.29%) | 98/177 (55.37%) | hypothetical protein, *Thermobifida fusca* |
| | | | NP_644099.1, 158aa | 1E-08 | 35/107 (32.71%) | 58/107 (54.21%) | hypothetical protein, *Xanthomonas axonopodis* |
| 8 | UNEX | 514 | E70508, 487aa | 4E-41 | 145/494 (29.35%) | 210/494 (42.51%) | hypothetical protein, *Mycobacterium tuberculosis* |
| | | | ZP_00059443.1, 554aa | 5E-39 | 155/516 (30.04%) | 216/516 (41.86%) | hypothetical protein, *Thermobifida fusca* |
| | | | NP_280206.1, 514aa | 1E-07 | 107/475 (22.53%) | 169/475 (35.58%) | hypothetical protein, *Halobacterium sp.* |
| 9 | GTFA | 367 | AAM94798.1, 376aa | 4E-69 | 155/370 (41.89%) | 205/370 (55.41%) | CalG3 glycosyltransferase, *Micromonospora echinospora* |
| | | | CAC16413.2, 382aa | 2E-60 | 150/373 (40.21%) | 187/373 (50.13%) | glycosyltransferase, *Streptomyces olivaceus* |
| | | | AAF01811.1, 390aa | 5E-54 | 138/374 (36.9%) | 179/374 (47.86%) | glycosyl transferase, *Streptomyces nogalater* |
| 10 | PKSH | 8147 | AAG23263.1, 4928aa | 1E-200 | 2487/5027 (49.47%) | 3043/5027 (60.53%) | polyketide synthase, *Saccharopolyspora spinosa* |
| | | | BAB69303.1, 6048aa | 1E-200 | 2452/4407 (55.64%) | 2853/4407 (64.74%) | polyketide synthase, *Streptomyces avermitilis* |
| | | | AAF71766.1, 9477aa | 1E-200 | 2489/4970 (50.08%) | 3044/4970 (61.25%) | NysI polyketide synthase, *Streptomyces noursei* |
| 11 | PKSH | 3428 | AAF71766.1, 9477aa | 1E-200 | 1763/3432 (51.37%) | 2086/3432 (60.78%) | NysI polyketide synthase, *Streptomyces noursei* |
| | | | AAK73501.1, 9510aa | 1E-200 | 1738/3394 (51.21%) | 2065/3394 (60.84%) | AmphI polyketide synthase, *Streptomyces nodosus* |
| | | | CAC20921.1, 9507aa | 1E-200 | 1729/3385 (51.08%) | 2050/3385 (60.56%) | PimS2 polyketide synthase, *Streptomyces natalensis* |
| 12 | PKSH | 6751 | AAF71766.1, 9477aa | 1E-200 | 2992/5949 (50.29%) | 3662/5949 (61.56%) | NysI polyketide synthase, *Streptomyces noursei* |
| | | | AAK73501.1, 9510aa | 1E-200 | 2961/5904 (50.15%) | 3650/5904 (61.82%) | AmphI polyketide synthase, *Streptomyces nodosus* |
| | | | CAC20921.1, 9507aa | 1E-200 | 2962/5917 (50.06%) | 3652/5917 (61.72%) | PimS2 polyketide synthase, *Streptomyces natalensis* |
| 13 | PKSH | 1657 | AAF71775.1, 3192aa | 1E-200 | 781/1553 (50.29%) | 938/1553 (60.4%) | NysB polyketide synthase, *Streptomyces noursei* |
| | | | BAB69196.1, 3613aa | 1E-200 | 775/1562 (49.62%) | 936/1562 (59.92%) | polyketide synthase, *Streptomyces avermitilis* |
| | | | AAG23266.1, 3170aa | 1E-200 | 775/1572 (49.3%) | 941/1572 (59.86%) | polyketide synthase, *Saccharopolyspora spinosa* |
| 14 | PKSH | 5207 | BAB69303.1, 6048aa | 1E-200 | 2713/5239 (51.78%) | 3215/5239 (61.37%) | polyketide synthase, *Streptomyces avermitilis* |
| | | | CAC20931.1, 6797aa | 1E-200 | 2651/5183 (51.15%) | 3187/5183 (61.49%) | PimS1 polyketide synthase, *Streptomyces natalensis* |
| | | | AAK73514.1, 10917aa | 1E-200 | 2047/4174 (49.04%) | 2494/4174 (59.75%) | AmphC polyketide synthase, *Streptomyces nodosus* |
| 15 | PKSH | 5432 | AAK73514.1, 10917aa | 1E-200 | 2814/5447 (51.66%) | 3377/5447 (62%) | AmphC polyketide synthase, *Streptomyces nodosus* |
| | | | AAF71776.1, 11096aa | 1E-200 | 2836/5548 (51.12%) | 3375/5548 (60.83%) | NysC polyketide synthase, *Streptomyces noursei* |
| | | | CAC20931.1, 6797aa | 1E-200 | 2824/5426 (52.05%) | 3378/5426 (62.26%) | PimS1 polyketide synthase, *Streptomyces natalensis* |
| 16 | PKSH | 3227 | AAF71775.1, 3192aa | 1E-200 | 1628/3207 (50.76%) | 1957/3207 (61.02%) | NysB polyketide synthase, *Streptomyces noursei* |
| | | | AAF82408.1, 4150aa | 1E-200 | 1643/3237 (50.76%) | 1957/3237 (60.46%) | deoxyoleandolide synthase, *Streptomyces antibioticus* |

TABLE 1-continued

| ORF | Family | #aa | GenBank homology | probability | % identity | % similarity | proposed function of GenBank match |
|---|---|---|---|---|---|---|---|
| | | | BAB69307.1, 3352aa | 1E−200 | 1612/3170 (50.85%) | 1948/3170 (61.45%) | polyketide synthase, *Streptomyces avermitilis* |
| 17 | PKSH | 7510 | AAK73502.1, 5644aa | 1E−200 | 2761/5719 (48.28%) | 3366/5719 (58.86%) | AmphJ polyketide synthase, *Streptomyces nodosus* |
| | | | AAF71776.1, 11096aa | 1E−200 | 2313/4464 (51.81%) | 2755/4464 (61.72%) | NysC polyketide synthase, *Streptomyces noursei* |
| | | | CAA60460.1, 8563aa | 1E−200 | 2448/5643 (43.38%) | 3074/5643 (54.47%) | polyketide synthase, *Streptomyces hygroscopicus* |
| 18 | PKSH | 3872 | AAK73514.1, 10917aa | 1E−200 | 1913/3588 (53.32%) | 2273/3588 (63.35%) | AmphC polyketide synthase, *Streptomyces nodosus* |
| | | | AAF71776.1, 11096aa | 1E−200 | 1907/3684 (51.76%) | 2280/3684 (61.89%) | NysC polyketide synthase, *Streptomyces noursei* |
| | | | CAC20931.1, 6797aa | 1E−200 | 1879/3564 (52.72%) | 2241/3564 (62.88%) | PimS1 polyketide synthase, *Streptomyces natalensis* |
| 19 | AYTF | 338 | D83961, 313aa | 1E−09 | 72/294 (24.49%) | 118/294 (40.14%) | malonyl CoA-ACP transacylase, *Bacillus halodurans* |
| | | | AAL20123.1, 309aa | 1E−08 | 73/303 (24.09%) | 120/303 (39.6%) | malonyl-CoA-ACP transacylase, *Salmonella typhimurium* |
| | | | AAK60008.1, 316aa | 1E−07 | 74/286 (25.87%) | 110/286 (38.46%) | malonyl-CoA-ACP transacylase, *Streptomyces aureofaciens* |
| 20 | MEAY | 283 | AD2333, 275aa | 6E−11 | 60/220 (27.27%) | 97/220 (44.09%) | hypothetical protein, *Nostoc* sp. |
| | | | S76277, 294aa | 2E−08 | 70/255 (27.45%) | 112/255 (43.92%) | hypothetical protein, *Synechocystis* sp. |
| | | | ZP_00019722.1, 251aa | 6E−08 | 56/224 (25%) | 99/224 (44.2%) | hypothetical protein, *Chloroflexus aurantiacus* |
| 21 | ABCD | 329 | ZP_00080468.1, 308aa | 1E−54 | 142/334 (42.51%) | 176/334 (52.69%) | hypothetical protein, *Geobacter metallireducens* |
| | | | D72257, 327aa | 5E−52 | 131/330 (39.7%) | 186/330 (56.36%) | hypothetical protein, *Thermotoga maritima* |
| | | | NP_578312.1, 321aa | 5E−49 | 121/327 (37%) | 176/327 (53.82%) | daunorubicin resistance protein, *Pyrococcus furiosus* |
| 22 | DEPL | 317 | CAA07388.1, 305aa | 4E−73 | 152/290 (52.41%) | 173/290 (59.66%) | StrL, *Streptomyces glaucescens* |
| | | | AAF59936.1, 294aa | 5E−65 | 139/285 (48.77%) | 165/285 (57.89%) | 4-ketoreductase, *Streptomyces antibioticus* |
| | | | AAF01815.1, 291aa | 8E−63 | 136/289 (47.06%) | 161/289 (55.71%) | dTDP-4-dehydrorhamnose reductase, *Streptomyces nogalater* |
| 23 | EPIM | 204 | CAA44442, 200aa | 1E−56 | 108/195 (55.38%) | 137/195 (70.26%) | epimerase, *Streptomyces griseus* |
| | | | CAA55578.1, 200aa | 2E−55 | 108/191 (56.54%) | 129/191 (67.54%) | epimerase, *Streptomyces glaucescens* |
| | | | AAG29805.1, 198aa | 1E−51 | 104/188 (55.32%) | 121/188 (64.36%) | epimerase, *Streptomyces rishiriensis* |
| 24 | NUTA | 328 | CAA68514.1, 355aa | 1E−125 | 215/328 (65.55%) | 263/328 (80.18%) | sugaractivating enzyme, *Streptomyces griseus* |
| | | | BAC55207.1, 350aa | 1E−122 | 217/328 (66.16%) | 261/328 (79.57%) | glucose-1-phosphate thymidyltransferase, *Streptomyces* sp. |
| | | | AAF59934.1, 356aa | 1E−119 | 214/329 (65.05%) | 260/329 (79.03%) | dTDP-D-glucose synthase, *Streptomyces antibioticus* |
| 25 | DEPA | 328 | NP_625052.1, 324aa | 1E−108 | 201/318 (63.21%) | 218/318 (68.55%) | putative dehydratase, *Streptomyces coelicolor* |
| | | | CAA07755.1, 331aa | 1E−107 | 200/317 (63.09%) | 218/317 (68.77%) | dTDP-glucose 4,6-dehydratase, *Streptomyces argillaceus* |
| | | | AAF82605.1, 317aa | 1E−105 | 191/318 (60.06%) | 214/318 (67.3%) | dTDP-glucose 4,6-dehydratase, *Streptomyces rimosus* |
| 26 | TESA | 214 | BAB69315.1, 255aa | 7E−22 | 74/239 (30.96%) | 97/239 (40.59%) | thioesterase, *Streptomyces avermitilis* |
| | | | T17413, 281aa | 3E−17 | 73/242 (30.17%) | 95/242 (39.26%) | thioesterase, *Streptomyces venezuelae* |
| | | | AAC01736.1, 254aa | 3E−15 | 61/225 (27.11%) | 88/225 (39.11%) | thioesterase, *Amycolatopsis mediterranei* |
| 27 | CALB | 470 | ZP_00025699.1, 510aa | 1E−27 | 116/466 (24.89%) | 188/466 (40.34%) | hypothetical protein, *Ralstonia metallidurans* |
| | | | ZP_00006768.1, 501aa | 5E−22 | 125/474 (26.37%) | 192/474 (40.51%) | hypothetical protein, *Rhodobacter sphaeroides* |
| | | | G87227, 548aa | 1e−20 | 120/495 (24.24%) | 195/495 (39.39%) | acyl-CoA synthase, *Mycobacterium leprae* |
| 28 | TMOA | 553 | CAB76876.1, 565aa | 1E−200 | 318/522 (60.92%) | 383/522 (73.37%) | amino oxidase, *Streptomyces coelicolor* |
| | | | ZP_00086824.1, 560aa | 1E−172 | 280/521 (53.74%) | 369/521 (70.83%) | hypothetical protein, *Pseudomonas fluorescens* |
| | | | ZP_00126831.1, 559aa | 1E−171 | 280/521 (53.74%) | 370/521 (71.02%) | tryptophan monooxygenase, *Pseudomonas syringae* |
| 29 | PPTF | 231 | CAA19952.1, 226aa | 3E−50 | 115/226 (50.88%) | 132/226 (58.41%) | hypothetical protein, *Streptomyces coelicolor* |
| | | | AAG43513.1, 246aa | 1E−43 | 105/228 (46.05%) | 127/228 (55.7%) | phosphopantetheinyl transferase, *Streptomyces verticillus* |
| | | | BAA22407.1, 208aa | 5E−36 | 91/214 (42.52%) | 109/214 (50.93%) | hypothetical protein, *Streptomyces* sp. |

TABLE 1-continued

| ORF | Family | #aa | GenBank homology | probability | % identity | % similarity | proposed function of GenBank match |
|---|---|---|---|---|---|---|---|
| 30 | UNAK | 306 | CAA19951.1, 295aa | 2E-97 | 169/275 (61.45%) | 195/275 (70.91%) | hypothetical protein, Streptomyces coelicolor |
|  |  |  | AAL15596.1, 293aa | 1E-91 | 163/269 (60.59%) | 190/269 (70.63%) | Sim18, Streptomyces antibioticus |
|  |  |  | NP_217311.1, 324aa | 8E-89 | 159/276 (57.61%) | 187/276 (67.75%) | hypothetical protein, Mycobacterium tuberculosis |
| 31 | REGD | 998 | AAC68887.1, 928aa | 1E-113 | 331/1014 (32.64%) | 445/1014 (43.89%) | transcriptional activator, Streptomyces venezuelae |
|  |  |  | AAM88362.1, 945aa | 1E-110 | 323/1007 (32.08%) | 438/1007 (43.5%) | NbmM regulator, Streptomyces narbonensis |
|  |  |  | AAC38065.1, 948aa | 1E-105 | 322/1019 (31.6%) | 427/1019 (41.9%) | regulatory protein, Streptomyces hygroscopicus |
| 32 | CTFC | 518 | NP_629669.1, 527aa | 1E-200 | 461/516 (89.34%) | 487/516 (94.38%) | carboxyl transferase, Streptomyces coelicolor |
|  |  |  | AAK06793.1, 528aa | 1E-200 | 423/510 (82.94%) | 464/510 (90.98%) | putative decarboxylase, Streptomyces antibioticus |
|  |  |  | AAD13544.1, 524aa | 1E-200 | 411/511 (80.43%) | 450/511 (88.06%) | decarboxylase, Streptomyces cyanogenus |
| 33 | ADHY | 329 | CAD55203.1, 322aa | 1E-140 | 240/314 (76.43%) | 273/314 (86.94%) | putative agmatinase, Streptomyces coelicolor |
|  |  |  | ZP_00057179.1, 324aa | 1E-128 | 216/312 (69.23%) | 260/312 (83.33%) | hypothetical protein, Thermobifida fusca |
|  |  |  | BAB96819.1, 353aa | 1E-119 | 206/307 (67.1%) | 252/307 (82.08%) | guanidinobutyrase, Arthrobacter sp. |
| 34 | ADSN | 521 | AAG29784.1, 529aa | 6E-86 | 189/512 (36.91%) | 255/512 (49.8%) | ligase, Streptomyces rishiriensis |
|  |  |  | AAN65228.1, 527aa | 1E-81 | 183/512 (35.74%) | 252/512 (49.22%) | amide synthetase, Streptomyces roseochromogenes |
|  |  |  | AAG34183.1, 519aa | 3E-74 | 186/515 (36.12%) | 248/515 (48.16%) | aminocoumarin ligase, Streptomyces antibioticus |
| 35 | AYTP | 410 | NP_697353.1, 425aa | 1E-104 | 193/385 (50.13%) | 252/385 (65.45%) | 5-aminolevulinic acid synthase, Brucella suis |
|  |  |  | AAL52785.1, 425aa | 1E-103 | 192/385 (49.87%) | 250/385 (64.94%) | 5-aminolevulinic acid synthase, Brucella melitensis |
|  |  |  | BAB52860.1, 425aa | 1E-102 | 191/385 (49.61%) | 249/385 (64.68%) | 5-aminolevulinic acid synthase, Mesorhizobium loti |
| 36 | CALB | 506 | CAB89029.1, 511aa | 1E-134 | 256/505 (50.69%) | 319/505 (63.17%) | long-chain-fatty-acid-CoA ligase, Streptomyces coelicolor |
|  |  |  | ZP_00059397.1, 557aa | 1E-122 | 241/505 (47.72%) | 315/505 (62.38%) | hypothetical protein, Thermobifida fusca |
|  |  |  | ZP_00105928.1, 513aa | 7E-78 | 185/501 (36.93%) | 260/501 (51.9%) | hypothetical protein, Nostoc punctiforme |
| 37 |  | 217 | NP_635504.1, 210aa | 6E-11 | 54/139 (38.85%) | 77/139 (55.4%) | regulatory protein, Xanthomonas campestris |
|  |  |  | BAB84309.1, 221aa | 6E-11 | 66/221 (29.86%) | 101/221 (45.7%) | response regulator, Halomonas halodenitrificans |
|  |  |  | NP_631750.1, 226aa | 8E-11 | 71/218 (32.57%) | 99/218 (45.41%) | response regulator, Streptomyces coelicolor |
| 38 |  | 442 | CAA18514, 534aa | 1E-116 | 206/359 (57.38%) | 251/359 (69.92%) | hypothetical protein, Streptomyces coelicolor |
|  |  |  | ZP_00058746.1, 366aa | 7E-19 | 98/358 (27.37%) | 145/358 (40.5%) | hypothetical protein, Thermobifida fusca |
|  |  |  | AAK47101, 352aa | 3E-08 | 85/357 (23.81%) | 130/357 (36.42%) | hypothetical protein, Mycobacterium tuberculosis |

The gene product of each of ORFs 1-38 in the compound 2(a) locus is assigned a protein family based on sequence similarity to the structure of known proteins as determined in Table 1. A putative function is attributed to each gene product of the compound 2(a) locus biosynthetic locus based on the known function of members of the respective protein families. Each protein family is referred to by a four-letter designation used throughout the description and figures. For example, members of protein family ABCD including the gene product of ORF 21 (SEQ ID NO: 43) are transmembrane transporters; members of protein family ADHY including the gene product ORF 33 (SEQ ID NO: 67) are amidinohydrolases; members of protein family ADSN including the gene product of ORF 34 (SEQ ID NO: 69) are adenylation/condensing enzymes; members of protein families AYTF and AYTP including ORFs 19 and 35 (SEQ ID NOS: 39 and 71) are acyltransferases; members of protein family CALB are acyl CoA ligases including ORF 27 and 36 (SEQ ID NO: 55 and 73); members of protein family CTFC including ORF 32 (SEQ ID NO: 65) are carboxyltransferase/decarbdxylases; members of protein families DEPA and DEPL including ORFs 25 and 22 (SEQ ID NOS: 51 and 45) are dehydratase/epimerases; members of protein family EPIM including ORF 23 (SEQ ID NO: 47) are epimerises; members of protein family GTFA including ORF 9 (SEQ ID NO: 19) are glycosyl transferases; members of protein family MEAY including ORF 20 (SEQ ID NO: 41) are membrane proteins; members of protein family NUTA including QRF 24 (SEQ ID NO: 49) are nucleotidyltransferases; members of protein family PKSH including ORFs 10, 11, 12, 13, 14, 15, 16, 17 and 18 (SEQ ID NOS: 21, 23, 25, 27, 29, 31, 33, 35 and 37) are polyketide synthase, type I proteins; members of PPTF protein family including ORF 29 (SEQ ID NO: 59) are phosphopantetheinyl transferases; members of protein family REGD including ORFs 3 and 31 (SEQ ID NOS: 6 and 63) are transcriptional regulators; members of protein family RREB including ORF 4 (SEQ ID NO: 8) are response regulators; members of protein family SPKK including ORF 5 (SEQ ID NO: 10) are sensory protein kinases; members of protein family TESA including ORFs 2 and 26 (SEQ ID NOS: 4 and 53) are thioesterases; and members of protein family TMOA including ORF 28 (SEQ ID NO: 57) are monooxygenases. A more detailed description of the function of each protein family is provided in Table 2. The correlation between structure and function for each protein family is provided in Table 2.

TABLE 2

| Protein Family | Function |
| --- | --- |
| ABCD | ABC transporter; ATP-binding cassette transmembrane transporter; includes proteins with similarity to Mdr proteins of mammalian tumor cells that confer resistance to chemotherapeutic agents. |
| ADHY | amidinohydrolase; agmatine ureohydrolase; hydrolyzes linear amidines; requires manganese for catalysis and contains a conserved His important for catalytic function |
| ADSN | Adenylating/condensing synthase; amide synthase; enzymes able to activate substrates as acyl adenylates and subsequently transfer the acyl group to an amino group of the acceptor molecule |
| AYTF | acyltransferase; acyl CoA-acyl carrier protein transacylase; includes malonyl CoA-ACP transacylases |
| AYTP | acyltransferase; pyridoxal phosphate-dependent; includes 5-aminolevulinate synthase, a glycyl transferase that condenses glycine and succinyl-CoA. |
| CALB | acyl CoA ligase; shows similarity to plant coumarate CoA ligases, other aryl CoA ligases, yeast CoA synthetase and aminocoumarin ligases. |
| CTFC | carboxyltransferase/decarboxylase; carboxyltransferase component of acetyl-CoA carboxylase, generally a 2 subunit component, this family consists of a fusion of the beta and alpha subunits (beta-alpha). |
| DEPA | dehydratase/epimerase; dTDP-glucose 4,6-dehydratases, catalyze the second step in 6-deoxyhexose biosynthesis. |
| DEPL | dehydratase/epimerase; similar to StrL dTDP-dihydrostreptose synthase; OleU 4-ketoreductase; SnogC putative dTDP-4-dehydrorhamnose reductase |
| EPIM | epimerase; NDP-hexose epimerase; TDP-4-ketohexose-3,5-epimerases, convert TDP-4-keto-6-deoxy-D-glucose to TDP-4-keto-6-deoxy-L-mannose (TDP-4-keto-L-rhamnose). |
| GTFA | glycosyl transferase. |
| MEAY | membrane protein; putative transporter, permease |
| NUTA | nucleotidyltransferase; dNDP-glucose synthase; alpha-D-glucose-1-phosphate thymidylyltransferase; catalyze the first step in 6-deoxyhexose biosynthesis. |
| PKSH | polyketide synthase, type I. |
| PPTF | phosphopantetheinyl transferases, required for activation of both PKSs and NRPSs from inactive apo forms to active holo forms. |
| REGD | transcriptional regulator |
| RREB | response regulator; similar to response regulators that are known to bind DNA and act as transcriptional activators |
| SPKK | sensory protein kinase. |
| TESA | thioesterase. |
| TMOA | monooxygenase; strong similarity to plasmid-encoded tryptophan-2-monooxygenases. |
| UNAK | unknown; homolog of *S. coelicolor* hypothetical protein |
| UNEW | unknown; similar to putative integral membrane protein in *S. coelicolor* |
| UNEX | unknown; domain homology to many bacterial putative membrane proteins; contain so-called "bacterial membrane flanked domains" found in an uncharacterised family of membrane proteins that have one to three copies of the domain flanked by transmembrane helices. |
| UNFI | unknown; similar to putative membrane proteins |

Biosynthesis of Compound 2(a) involves the multimodular type I polyketide synthase system (PKS) of ORFs 10 to 18 (SEQ ID NOS: 21, 23, 25, 27, 29, 31, 33, 35 and 37) illustrated in FIG. 1. Type I PKSs are large modular proteins that condense acyl thioester units in a sequential manner. PKS systems consist of one or more polyfunctional polypeptides each of which is made up of modules. Each type I PKS module contains three domains; a β-ketoacyl protein synthase (KS), an acyltransferase (AT) and an acyl carrier protein (ACP). Domains conferring additional enzymatic activities such as ketoreductase (KR), dehydratase (DH) and enoylreductase (ER) can also be found in the PKS modules. These additional domains result in various degrees of reduction of the β-keto groups of the growing polyketide chain. Each module is responsible for one round of condensation and reduction of the β-ketoacyl units. There is a direct correlation between the number of modules and the length of the polyketide chain as well as between the domain composition of the modules and the degree of reduction of the polyketide product. The final polyketide product is released from the PKS protein through the action of a thioesterase domain found in the ultimate module of the PKS system. The genetic organization of most type I PKS enzymes is colinear with the order of biochemical reactions giving rise to the polyketide chain. One skilled in the art will readily understand that these features allow prediction of polyketide core structure based on the architecture of the PKS modules found in a given biosynthetic pathway [Hopwood, *Chem. Rev.*, 97:2465-2497 (1997)].

The compound 2(a) locus PKS system is composed of ORFs 10 to 18 (SEQ ID NOS: 21, 23, 25, 27, 29, 31, 33, 35 and 37) and comprises a total of 27 modules described in Table 3. The first module contains only an ACP domain and corresponds to the loading module (module 0) whereas each of the remaining 26 modules contain domains KS, AT and ACP in various combinations with KR, DH and ER domains. The thioesterase domain present in ORF 18/module 26 indicates that this module is the ultimate one in the biosynthesis of the polyketide chain. Dehydratase domains in modules 6 and 11 as well as ketoreductase domain in module 12 appear to be inactive due to the presence of non-conservative amino acid residues in highly conserved regions important for catalysis.

TABLE 3 compound 2(a) locus PKS domain coordinates

| ORF no. | SEQ ID NO Amino acid/ Nucleic acid | Amino Acid Residue | Nucleic Acid | Homology | Module no. |
| --- | --- | --- | --- | --- | --- |
| 10 | 21/22 | 57-118 | 169-354 | ACP | 0 |
|  | 21/22 | 141-566 | 421-1698 | KS | 1 |
|  | 21/22 | 597-1031 | 1789-3093 | AT |  |
|  | 21/22 | 1304-1517 | 3910-4551 | KR |  |
|  | 21/22 | 1603-1664 | 4807-4992 | ACP |  |
|  | 21/22 | 1690-2118 | 5068-6354 | KS | 2 |
|  | 21/22 | 2135-2562 | 6403-7686 | AT |  |
|  | 21/22 | 2833-3045 | 8497-9135 | KR |  |
|  | 21/22 | 3130-3191 | 9388-9573 | ACP |  |
|  | 21/22 | 3215-3640 | 9643-10920 | KS | 3 |
|  | 21/22 | 3660-4089 | 10978-12267 | AT |  |
|  | 21/22 | 4102-4208 | 12304-12624 | DH |  |
|  | 21/22 | 4612-4829 | 13834-14487 | KR |  |
|  | 21/22 | 4911-4972 | 14731-14916 | ACP |  |
|  | 21/22 | 5007-5438 | 15019-16314 | KS | 4 |
|  | 21/22 | 5460-5883 | 16378-17649 | AT |  |
|  | 21/22 | 6147-6360 | 18439-19080 | KR |  |
|  | 21/22 | 6444-6505 | 19330-19515 | ACP |  |
|  | 21/22 | 6529-6954 | 19585-20862 | KS | 5 |
|  | 21/22 | 6979-7402 | 20935-22206 | AT |  |
|  | 21/22 | 7703-7918 | 23107-23754 | KR |  |
|  | 21/22 | 8002-8063 | 24004-24189 | ACP |  |
| 11 | 23/24 | 37-462 | 109-1386 | KS | 6 |
|  | 23/24 | 493-919 | 1477-2757 | AT |  |

TABLE 3-continued compound 2(a) locus PKS domain coordinates

| ORF no. | SEQ ID NO Amino acid/ Nucleic acid | Amino Acid Residue | Nucleic Acid | Homology | Module no. |
|---|---|---|---|---|---|
| | 23/24 | 932-1038 | 2794-3114 | DH* | |
| | 23/24 | 1411-1672 | 4231-4881 | KR | |
| | 23/24 | 1706-1767 | 5116-5301 | ACP | |
| | 23/24 | 1794-2215 | 5380-6645 | KS | 7 |
| | 23/24 | 2232-2659 | 6694-7977 | AT | |
| | 23/24 | 2960-3173 | 8878-9519 | KR | |
| | 23/24 | 3258-3319 | 9772-9957 | ACP | |
| 12 | 25/26 | 36-461 | 106-1383 | KS | 8 |
| | 25/26 | 483-907 | 1447-2721 | AT | |
| | 25/26 | 919-1027 | 2755-3081 | DH | |
| | 25/26 | 1439-1655 | 4315-4965 | KR | |
| | 25/26 | 1736-1797 | 5206-5391 | ACP | |
| | 25/26 | 1831-2256 | 5491-6768 | KS | 9 |
| | 25/26 | 2281-2714 | 6841-8142 | AT | |
| | 25/26 | 2981-3194 | 8941-9582 | KR | |
| | 25/26 | 3287-3339 | 9832-10017 | ACP | |
| | 25/26 | 3361-3786 | 10081-11358 | KS | 10 |
| | 25/26 | 3803-4225 | 11407-12675 | AT | |
| | 25/26 | 4494-4706 | 13480-14118 | KR | |
| | 25/26 | 4795-4856 | 14383-14568 | ACP | |
| | 25/26 | 4880-5304 | 14638-15912 | KS | 11 |
| | 25/26 | 5323-5748 | 15967-17244 | AT | |
| | 25/26 | 5761-5866 | 17278-17598 | DH* | |
| | 25/26 | 6294-6510 | 18880-19530 | KR | |
| | 25/26 | 6599-6660 | 19795-19980 | ACP | |
| 13 | 27/28 | 35-460 | 103-1380 | KS | 12 |
| | 27/28 | 484-920 | 1450-2760 | AT | |
| | 27/28 | 1195-1406 | 3583-4218 | KR* | |
| | 27/28 | 1490-1551 | 4468-4653 | ACP | |
| 14 | 29/30 | 35-460 | 103-1380 | KS | 13 |
| | 29/30 | 487-918 | 1459-2754 | AT | |
| | 29/30 | 1219-1431 | 3655-4293 | KR | |
| | 29/30 | 1514-1575 | 4540-4725 | ACP | |
| | 29/30 | 1602-2027 | 4804-6081 | KS | 14 |
| | 29/30 | 2046-2473 | 6136-7419 | AT | |
| | 29/30 | 2486-2592 | 7456-7776 | DH | |
| | 29/30 | 2980-3196 | 8938-9588 | KR | |
| | 29/30 | 3287-3339 | 9832-10017 | ACP | |
| | 29/30 | 3363-3788 | 10087-11364 | KS | 15 |
| | 29/30 | 3810-4237 | 11428-12711 | AT | |
| | 29/30 | 4249-4355 | 12745-13065 | DH | |
| | 29/30 | 4760-4976 | 14278-14928 | KR | |
| | 29/30 | 5060-5124 | 15187-15372 | ACP | |
| 15 | 31/32 | 35-460 | 103-1380 | KS | 16 |
| | 31/32 | 480-914 | 1438-2742 | AT | |
| | 31/32 | 926-1032 | 2776-3096 | DH | |
| | 31/32 | 1423-1639 | 4267-4917 | KR | |
| | 31/32 | 1737-1798 | 5209-5394 | ACP | |
| | 31/32 | 1822-2247 | 5464-6741 | KS | 17 |
| | 31/32 | 2263-2690 | 6787-8070 | AT | |
| | 31/32 | 2703-2809 | 8107-8427 | DH | |
| | 31/32 | 3188-3404 | 9562-10212 | KR | |
| | 31/32 | 3483-3544 | 10447-10632 | ACP | |
| | 31/32 | 3568-3993 | 10702-11979 | KS | 18 |
| | 31/32 | 4017-4442 | 12049-13326 | AT | |
| | 31/32 | 4456-4562 | 13366-13686 | DH | |
| | 31/32 | 4978-5194 | 14932-15582 | KR | |
| | 31/32 | 5285-5346 | 15853-16038 | ACP | |
| 16 | 33/34 | 35-460 | 103-1380 | KS | 19 |
| | 33/34 | 481-917 | 1441-2751 | AT | |
| | 33/34 | 1205-1416 | 3613-4248 | KR | |
| | 33/34 | 1500-1561 | 4498-4683 | ACP | |
| | 33/34 | 1585-2010 | 4753-6030 | KS | 20 |
| | 33/34 | 2067-2505 | 6199-7515 | AT | |
| | 33/34 | 2786-2998 | 8356-8994 | KR | |
| | 33/34 | 3083-3144 | 9247-9432 | ACP | |
| 17 | 35/36 | 40-465 | 118-1395 | KS | 21 |
| | 35/36 | 503-941 | 1507-2823 | AT | |
| | 35/36 | 954-1060 | 2860-3180 | DH | |
| | 35/36 | 1456-1672 | 4366-5016 | KR | |
| | 35/36 | 1751-1812 | 5251-5436 | ACP | |
| | 35/36 | 1835-2260 | 5503-6780 | KS | 22 |
| | 35/36 | 2281-2718 | 6841-8154 | AT | |
| | 35/36 | 2731-2837 | 8191-8511 | DH | |
| | 35/36 | 3188-3546 | 9562-10638 | ER | |
| | 35/36 | 3551-3767 | 10651-11301 | KR | |
| | 35/36 | 3846-3907 | 11536-11721 | ACP | |
| | 35/36 | 3932-4357 | 11794-13071 | KS | 23 |
| | 35/36 | 4373-4803 | 13117-14409 | AT | |
| | 35/36 | 4815-4921 | 14443-14763 | DH | |
| | 35/36 | 5300-5516 | 15898-16548 | KR | |
| | 35/36 | 5597-5658 | 16789-16974 | ACP | |
| | 35/36 | 5686-6111 | 17056-18333 | KS | 24 |
| | 35/36 | 6131-6557 | 18391-19671 | AT | |
| | 35/36 | 6572-6678 | 19714-20034 | DH | |
| | 35/36 | 7062-7288 | 21184-21834 | KR | |
| | 35/36 | 7363-7424 | 22087-22272 | ACP | |
| 18 | 37/38 | 34-459 | 100-1377 | KS | 25 |
| | 37/38 | 502-926 | 1504-2778 | AT | |
| | 37/38 | 938-1044 | 2812-3132 | DH | |
| | 37/38 | 1420-1636 | 4258-4908 | KR | |
| | 37/38 | 1715-1776 | 5143-5328 | ACP | |
| | 37/38 | 1799-2224 | 5395-6672 | KS | 26 |
| | 37/38 | 2247-2673 | 6739-8019 | AT | |
| | 37/38 | 2686-2792 | 8056-8376 | DH | |
| | 37/38 | 3203-3419 | 9607-10257 | KR | |
| | 37/38 | 3513-3574 | 10537-10722 | ACP | |
| | 37/38 | 3649-3872 | 10945-11616 | TE | |

One skilled in the art would understand that all KS domains are functional as the multiple amino acid alignment of KS domains present in the compound 2(a) locus PKS system (FIG. 2) shows an overall similarity of domains and conservation of amino acid residues and domain regions important for activity. Similarly, multiple amino acid alignment of AT domains (FIG. 3), ER domains (FIG. 5), ACP domains (FIG. 7) and TE domains (FIG. 8) show an overall similarity of related domains and a high conservation of protein regions and of amino acid residues important for catalytic activity. The domains that occur only once in the compound 2(a) locus PKS, namely the enoylreductase (ER) domain in ORF 17 (SEQ ID NO: 35) and the thioesterase (TE) domain in ORF 18 (SEQ ID NO: 37) are compared to prototypical domains from the nystatin type I polyketide system (FIGS. 5 and 8) (see Brauteset et al., supra).

Comparison of DH domains found in the compound 2(a) locus PKS indicates a high conservation of amino acid residues important for catalytic activity (FIG. 4). However, two DH domains are inactive as they contain non-conservative amino acid substitutions in a region of high sequence conservation. As highlighted in FIG. 4, the DH domain of module 6 in ORF 11 (SEQ ID NO: 23) and the DH domain of module 11 in ORF 12 (SEQ ID NO: 25) contain substitutions of charged amino acids arginine and glutamic acid respectively for non-charged aliphatic amino acids.

Comparison of KR domains found in the compound 2(a) locus PKS system also displays a conservation of active sites and amino acid residues important for catalysis with the exception of the KR domain of module 12 found in ORF 13 (SEQ ID NO: 27). FIG. 6 shows the presence in that module of a substitution of a glutamine (Q) for a highly conserved tyrosine (Y) amino acid residue. This non-conservative amino acid substitution results in the inactivation of the enzymatic activity of the KR domain of module 12 in ORF 13 (SEQ ID NO: 27) (ORF13_pKR01).

Phylogenetic analysis of the compound 2(a) locus PKS AT domains was conducted to assess the nature of the β-keto acyl units that are incorporated in the growing polyketide chain. The compound 2(a) locus PKS AT domains were compared to two domains, AAF71779mod03 and AAF71766mod11, derived from the nystatin PKS system [Brautaset, supra] and specifying the incorporation of malonyl-CoA and methylmalonyl-CoA respectively. FIG. 9 shows the phylogenetic relatedness of the various AT domains indicating that, in the compound 2(a) locus PKS, ORF 13 (SEQ ID NO: 27) module 12 as well as ORF 16 (SEQ ID NO: 33) modules 19 and 20 incorporate methylmalonate in the polyketide chain whereas all remaining AT domains incorporate malonate extender β-keto acyl units.

Figure 10:
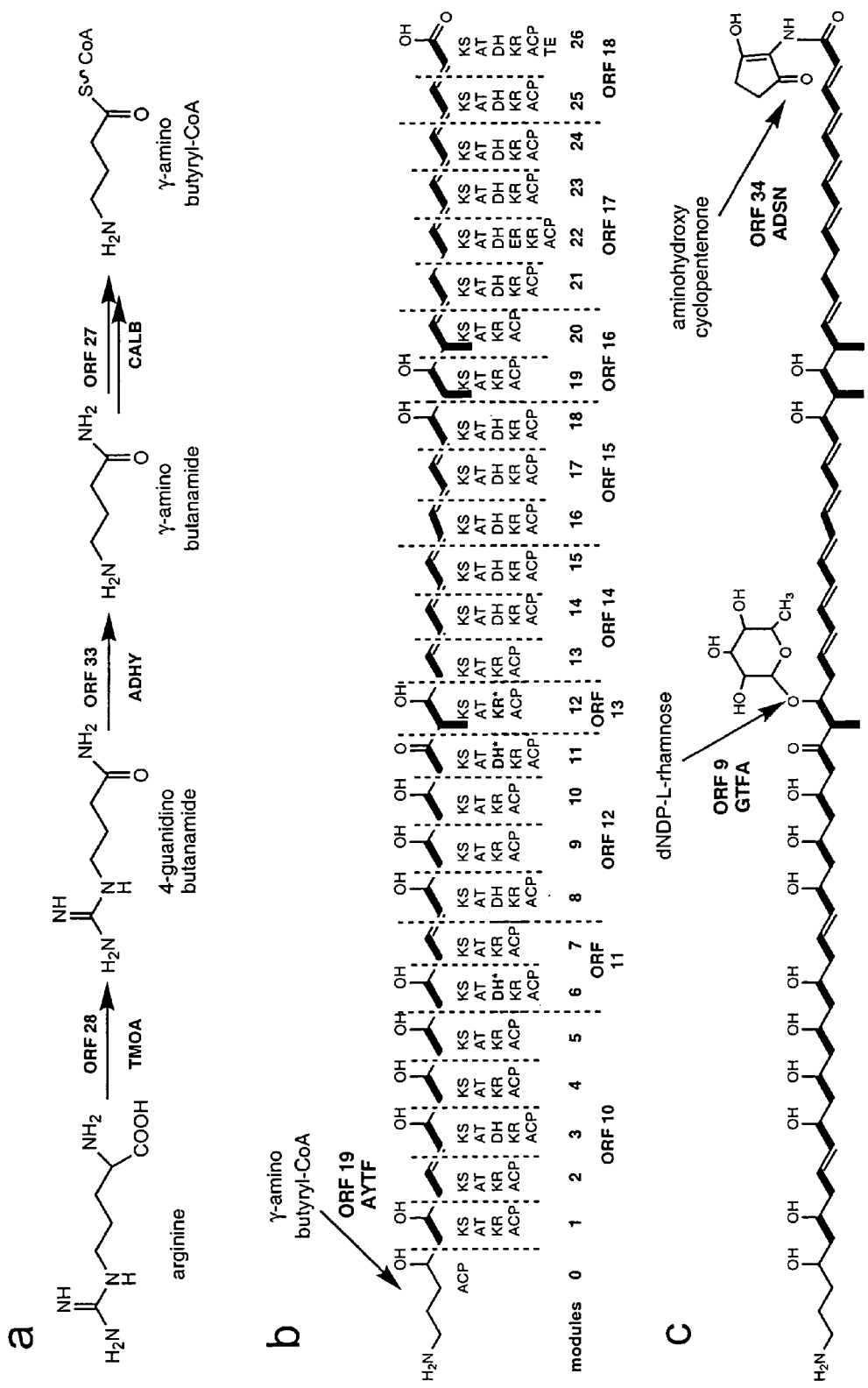

Domain analysis of the compound 2(a) locus PKS system provides clear indication as to synthesis of the polyketide core structure. While not intending to be limited to any particular mode of action or biosynthetic scheme, the nature and organization of the compound 2(a) locus PKS modules can explain the synthesis of Compound 2(a). FIG. 10 highlights schematically a series of reactions catalyzed by the polyketide synthase system based on the correlation between the deduced domain architecture and the polyketide core of the compounds 2(a). Type I PKS domains and the reactions they carry out are well known to those skilled in the art and well documented in the literature; see for example, Hopwood, supra.

A biosynthetic pathway for the production of the γ-aminobutyryl-CoA starter unit is also shown. The gene product of ORF 28 (SEQ ID NO: 57), a member of protein family TMOA, catalyzes the decarboxylative oxidation of arginine forming 4-guanidinobutanamide. The gene product of ORF 33 (SEQ ID NO: 67), a member of protein family ADHY, catalyzes hydrolysis of the amidino group forming γ-aminobutanamide that is further activated by either ORF 27 or 36 (SEQ ID NOS: 55 and 73 respectively), both members of protein family CALB, to give γ-aminobutyryl-CoA (FIG. 10a). The gene product of ORF 19 (SEQ ID NO: SEQ ID NO: 39), a member of protein family AYTF, loads this unusual extender unit onto the ACP domain of the loading module (module 0) of ORF 10 (SEQ ID NO: 21), a member of protein family PKSH, as illustrated in FIG. 10b. The polyketide chain continues to grow by the sequential condensation of malonyl-CoA and methylmalonyl-CoA extender units that are further reduced by specific domains to various degrees. Dehydratase domains found in module 6 of ORF 11 (SEQ ID NO: 23) and module 11 of ORF 12 (SEQ ID NO: 25) as well as the ketoreductase domain found in module 12 of ORF 13 (SEQ ID NO: 27) are inactive and consequently do not catalyze their respective reductive reactions. The mature polyketide chain is then released through the action of the thioesterase domain found in module 26 of ORF 18 (SEQ ID NO: 37), a member of protein family PKSH as illustrated in FIG. 10b. The polyketide core structure expected from the architecture of the PKS domains of the compound 2(a) locus is entirely consistent with the polyketide portion of the compound 2(a).

The compound 2(a) locus contains genes involved in the synthesis of two other components found in the chemical structure of the compound 2(a) locus. FIG. 11a illustrates a biosynthetic pathway for the production of the aminohydroxy-cyclopentenone moiety found in the compound 2(a) locus. The gene product of ORF 35 (SEQ ID NO: 71), a member of protein family AYTP, condenses glycine with succinyl-CoA forming 5-aminolevulinate. This intermediate is further activated through the action of either the gene products of ORF 27 or 36 (SEQ ID NOS: 55 and 73 respectively), both members of protein family CALB, forming 5-aminolevulinate-CoA that may spontaneously cyclize to produce aminohydroxycyclopentenone. This moiety is subsequently condensed to the activated carboxy terminus of the polyketide chain through the action of the gene product of ORF 34 (SEQ ID NO: 69), a member of protein family ADSN as illustrated in FIG. 10c.

FIG. 11b depicts the biosynthetic pathway of the deoxysugar component of Compound 2(a). The gene product of ORF 24 (SEQ ID NO: 49), a member of protein family NUTA, activates D-glucose forming dNDP-D-glucose that is subsequently dehydrated through the action of the gene product of ORF 25 (SEQ ID NO: 51), a member of protein family DEPA, forming dNDP-4-keto-4,6-dideoxy-D-glucose. The gene product of ORF 22 (SEQ ID NO: 45), a member of protein family DEPL, further reduces this intermediate forming dNDP-D-fucose that is subsequently epimerized by the gene product of ORF 23 (SEQ ID NO: 47), a member of protein family EPIM, producing dNDP-L-rhamnose.

The final deoxysugar moiety is transferred onto a hydroxyl group of the polyketide core structure through the action of a glycosyltransferase, i.e. the gene product of ORF 9 (SEQ ID NO: 19), a member of protein family GTFA, as illustrated in FIG. 10c. FIG. 10c proposes one scheme in regard to timing of the reactions catalyzed by the gene product of ORF 34 (SEQ ID NO: 69), a member of protein family CALB, and by the gene product of ORF 9 (SEQ ID NO: 19), a member of protein family GTFA. However, it will be readily understood that the invention does not reside in the actual timing and order of the reactions as depicted in FIG. 10c.

Additional proteins forming the compound 2(a) locus include the gene product of ORF 2 (SEQ ID NO: 4) and a member of protein family TESA which is expected to having polyketide-priming editing functions; the gene products of ORFs 3, 4, 5 and 31 (SEQ ID NOS: 6, 8, 10 and 63), members of protein families REGD, RREB, SPKK and REGD respectively, are expected to regulate synthesis of Compound 2(a); the gene products of ORFs 6 and 21 (SEQ ID NOS: 12 and 43), members of protein families UNEW and ABCD respectively, are involved in transmembrane transport; and the gene product of ORF 29 (SEQ ID NO: 59), a member of protein family PPTF, activates ACP domains through phosphopantetheinylation.

Structural modification of compound of Formula I and Formula II and Compound 2(a) are attained by the genetic modifications of the compound 2(a) locus. Genetic modifications of PKS biosynthetic loci are well known in the art. The WO 01/34816 patent publication teaches the construction of a library of structural variants of the macrolide polyketide rapamycin derived from the genetic modification of genes in the locus that directs rapamycin synthesis. The genetic modifications taught, include gene inactivation, gene insertion and gene replacement. These modifications, both individually and in combination at different positions within the rapamycin locus, resulted in alteration of polyketide starter units, chain length and hydroxyl sterospecificities in rapamycin. Similarly, McDaniel et. al. [Proc Natl Acad Sci USA, 1999, 96:18646-51] generated a library of over 50 derivatives of the macrolide antibiotic erythromycin using a combination of genetic modifications including gene inactivation, macrolide chain length and hydroxyl sterospecificity modifications of the erythromycin biosynthesis genes.

The elucidation of the nucleic acid sequences that encodes the biosynthesis of Compound 2a provides the biological tools to enable one skilled in the art to genetically modify the biosynthetic pathway to generate variants of the Compound 2a. In particular, Type I PKS systems may be manipulated by changing the number of modules, their specificities towards carboxylic acids, and by inactivating or inserting domains with reductive activities (Katz, Chem. Rev. v. 97, 2557-2575, 1997). Thus, the polyketide synthase system of Compound 2(a) may be engineered by modifying, adding, or deleting domains, or replacing them with those taken from other Type I PKS enzymes. Compounds of Formula I may be produced using a modified PKS system created based on the polyketide synthase system for the production of Compound 2a. Preferred modified PKS systems are those wherein a KS, AT, KR, DH or ER domain has been inactivated or deleted.

In one aspect, the invention is directed to preparation of a polyketide of Formula I or II resulting from a modified polyketide synthase system, which modification include deletions, mutagenesis, inactivation or replacement of one or more of the domains of the invention. The modified polyketide synthase system produces compounds of Formula I that may differ from the compound of Formula 2a in size, degree of saturation and oxidation. In another aspect, the invention is directed to compounds of Formula I or II produced by genetic modification of the polyketide synthase system for the compound 2(a) locus.

The compounds of this invention may be formulated into pharmaceutical compositions comprised of compounds of Formula I in combination with a pharmaceutically acceptable carrier.

The compounds of this invention are useful in treating bacterial infections, fungal infections and cancer.

Molecular terms, when used in this application, have their common meaning unless otherwise specified.

The term alkyl refers to a linear or branched hydrocarbon group. Examples of alkyl groups include, without limitation, methyl, ethyl, n-propyl, isopropyl, n-butyl, pentyl, hexyl, heptyl, cyclopentyl, cyclohexyl, cyclohexymethyl, and the like. Alkyl groups may optionally be substituted with one or more substituents selected from acyl; amino, acylamino, acyloxy, carboalkoxy, carboxy, carboxyamido, cyano, halo, hydroxyl, nitro, thio, alkyl, alkenyl, alkynyl, cycloalkyl, heterocyclyl, aryl, heteroaryl, alkoxy, aryloxy, sulfinyl, sulfonyl, oxo, guanidino and formyl.

The term alkenyl refers to a linear, branched or cyclic hydrocarbon group containing at least one carbon-carbon double bond. Examples of alkenyl groups include, without limitation, vinyl, 1-propene-2-yl, 1-butene-4-yl, 2-butene-4-yl, 1-pentene-5-yl and the like. Alkenyl groups may optionally be substituted with one or more substituents selected from acyl, amino, acylamino, acyloxy, carboalkoxy, carboxy, carboxyamido, cyano, halo, hydroxyl, nitro, thio, alkyl, alkenyl, alkynyl, cycloalkyl, heterocyclyl, aryl, heteroaryl, alkoxy, aryloxy, sulfinyl, sulfonyl, formyl, oxo and guanidino. The double bond portion(s) of the unsaturated hydrocarbon chain may be either in the cis or trans configuration.

The term cycloalkyl or cycloalkyl ring refers to a saturated or partially unsaturated carbocyclic ring in a single or fused carbocyclic ring system having from three to fifteen ring members. Examples of cycloalkyl groups include, without limitation, cyclopropyl, cyclobutyl, cyclohexyl, and cycloheptyl. Cycloalkyl groups may optionally be substituted with one ore more substituents selected from acyl, amino, acylamino, acyloxy, carboalkoxy, carboxy, carboxyamido, cyano, halo, hydroxyl, nitro, thio, alkyl, alkenyl, alkynyl, cycloalkyl, heterocyclyl, aryl, heteroaryl, alkoxy, aryloxy, sulfinyl, sulfonyl and formyl.

The term heterocycloalkyl, heterocyclic or heterocycloalkyl ring refers to a saturated or partially unsaturated ring containing one to four hetero atoms or hetero groups selected from O, N, NH, $NR^x$, $PO_2$, S, SO or $SO_2$ in a single or fused heterocyclic ring system having from three to fifteen ring members. Examples of heterocycloakyl groups include, without limitation, morpholinyl, piperidinyl, and pyrrolidinyl. Heterocycloalkyl groups may optionally be substituted with one or more substituents selected from acyl, amino, acylamino, acyloxy, oxo, thiocarbonyl, imino, carboalkoxy, carboxy, carboxyamido, cyano, halo, hydroxyl, nitro, thio, alkyl, alkenyl, alkynyl, cycloalkyl, heterocyclyl, aryl, heteroaryl, alkoxy, aryloxy, sulfinyl, sulfonyl and formyl.

The term amino acid refers to a natural amino acid, a synthetic amino acid or a synthetic derivative of a natural amino acid. Examples of natural amino acids include, but are not limited to alanine, arginine, asparagine, aspartic acid, cysteine, glutamic acid, glutamine, glycine, histidine, isoleucine, leucine, lysine, methionine, phenylalanine, proline, serine, threonine, tryptophan, tyrosine and valine.

The term halo is defined as a bromine, chlorine, fluorine or iodine atom.

The term aryl or aryl ring refers to an aromatic group comprising a single or fused ring system, having from five to fifteen ring members. Examples of aryl groups include, without limitation, phenyl, naphthyl, biphenyl, terphenyl. Aryl groups may optionally be substituted with one or more substituent group selected from acyl, amino, acylamino, acyloxy, azido, alkythio, carboalkoxy, carboxy, carboxyamido, cyano, halo, hydroxyl, nitro, thio, alkyl, alkenyl, alkynyl, cycloalkyl, heterocyclyl, aryl, heteroaryl, alkoxy, aryloxy, sulfinyl, sulfonyl and formyl.

The term heteroaryl or heteroaryl ring refers to an aromatic group comprising a single or fused ring system, having from five to fifteen ring members and containing at least one hetero atom such as O, N, S, SO and $SO_2$. Examples of heteroaryl groups include, without limitation, pyridinyl, thiazolyl, thiadiazoyl, isoquinolinyl, pyrazolyl, oxazolyl, oxadiazoyl, triazolyl, and pyrrolyl groups. Heteroaryl groups may optionally be substituted with one or more substituent groups selected from acyl, amino, acylamino, acyloxy, carboalkoxy, carboxy, carboxyamido, cyano, halo, hydroxyl, nitro, thio, thiocarbonyl, alkyl, alkenyl, alkynyl, cycloalkyl, heterocyclyl, aryl, heteroaryl, alkoxy, aryloxy, sulfinyl, sulfonyl, and formyl.

As used herein, the term "treatment" refers to the application or administration of a therapeutic agent to a patient, or application or administration of a therapeutic agent to an isolated tissue or cell line from a patient, who has a disorder, e.g., a disease or condition, a symptom of disease, or a predisposition toward a disease, with the purpose to cure, heal, alleviate, relieve, alter, remedy, ameliorate, improve, or affect the disease, the symptoms of disease, or the predisposition toward disease.

As used herein, a "pharmaceutical composition" comprises a pharmacologically effective amount of a farnesyl dibenzodiazepinone and a pharmaceutically acceptable carrier. As used herein, "pharmacologically effective amount," "therapeutically effective amount" or simply "effective amount" refers to that amount of a farnesyl dibenzodiazepinone effective to produce the intended pharmacological, therapeutic or preventive result. For example, if a given clinical treatment is considered effective when there is at least a 25% reduction in a measurable parameter associated with a disease or disorder, a therapeutically effective amount of a drug for the treatment of that disease or disorder is the amount necessary to effect at least a 25% reduction in that parameter.

The term "pharmaceutically acceptable carrier" refers to a carrier for administration of a therapeutic agent. Such carriers include, but are not limited to, saline, buffered saline, dextrose, water, glycerol, ethanol, and combinations thereof. The term specifically excludes cell culture medium. For drugs administered orally, pharmaceutically acceptable carriers include, but are not limited to pharmaceutically acceptable excipients such as inert diluents, disintegrating agents, binding agents, lubricating agents, sweetening agents, flavoring agents, coloring agents and preservatives. Suitable inert diluents include sodium and calcium carbonate, sodium and calcium phosphate, and lactose, while corn starch and alginic acid are suitable disintegrating agents. Binding agents may include starch and gelatin, while the lubricating agent, if present, will generally be magnesium stearate, stearic acid or talc. If desired, the tablets may be coated with a material such as glyceryl monostearate or glyceryl distearate, to delay absorption in the gastrointestinal tract.

Pharmaceutically acceptable salts include acid addition salts and base addition salts. The nature of the salt is not critical, provided that it is pharmaceutically-acceptable. Without being limited, examples of acid addition salts include hydrochloric, hydrobromic, hydroiodic, nitric, carbonic, sulphuric, phosphoric, formic, acetic, citric, tartaric, succinic, oxalic, malic, glutamic, propionic, glycolic, gluconic, maleic, embohic (pamoic), methanesulfonic, ethanesulfonic, 2-hydroxyethanesulfonic, pantothenic, benzenesulfonic, toluenesulfonic, sulfanilic, mesylic, cyclohexylaminosulfonic, stearic, algenic, β-hydroxybutyric, malonic, galactantic, galacturonic acid and the like. Suitable pharmaceutically-acceptable base addition salts of compounds of the invention include, but are not limited to, metallic salts made from aluminium, calcium, lithium, magnesium, potassium, sodium and zinc or organic salts made from N,N'-dibenzylethylenediamine, chloroprocaine, choline, diethanolamine, ethylenediamine, N-methylglucamine, lysine, procaine and the like. Additional examples of pharmaceutically acceptable salts are listed in *Journal of Pharmaceutical Sciences*, 1977, 66:2. All of these salts may be prepared by conventional means form the corresponding compounds of Formula I by treating with the appropriate acid or base.

The compounds of the present invention can possess one or more asymetric carbon atoms and can exist as optical isomers forming mixtures of racemic or non-racemic compounds. The compounds of the present invention are useful as a single isomer or as a mixture of stereochemical isomeric forms. Diastereoisomers, i.e., nonsuperimposable stereochemical isomers, can be seperated by conventional means such as chromatography, distillation, crystallization and sublimation. The optical isomers can be obtained by resolution of the racemic mixtures according to conventional processes.

The invention embraces isolated compounds. An isolated compound refers to a compound which represents at least 10%, 20%, 50% and 80% of the compound of the present invention present in a mixture, provided that the mixture comprising the compound of the invention has demonstrable (i.e. statistically significant) biological activity including antibacterial, antifungal or anticancer activity when tested in conventional biological assays known to a person skilled in the art.

The compounds of the present invention, or pharmaceutically acceptable salts thereof, can be formulated for oral, intravenous, intramuscular, subcutaneous, topical or parenteral administration for the therapeutic or prophylactic treatment of diseases, particularly bacterial and fungal infections. For oral or parental administration, compounds of the present invention can be mixed with conventional pharmaceutical carriers and excipients and used in the form of tablets, capsules, elixirs, suspensions, syrups, wafers and the like. The compositions comprising a compound of this present invention will contain from about 0.1% to about 99.9%, about 5% to about 95%, about 10% to about 80% or about 15% to about 60% by weight of the active compound.

The pharmaceutical preparations disclosed herein are prepared in accordance with standard procedures and are administered at dosages that are selected to reduce, prevent, or eliminate bacterial and fungal infection or the cancer (See, e.g., Remington's Pharmaceutical Sciences, Mack Publishing Company, Easton, Pa. and Goodman and Gilman's the Pharmaceutical Basis of Therapeutics, Pergamon Press, New York, N.Y., the contents of which are incorporated herein by reference, for a general description of the methods for administering various antimicrobial agents for human therapy). The compositions of the present invention can be delivered using controlled (e.g., capsules) or sustained release delivery systems (e.g., bioerodable matrices). Exemplary delayed release delivery systems for drug delivery that are suitable for administration of the compositions of the invention (preferably of Formula I) are described in U.S. Pat. No. 4,452,775 (issued to Kent), U.S. Pat. No. 5,239,660 (issued to Leonard), U.S. Pat. No. 3,854,480 (issued to Zaffaroni).

The pharmaceutically-acceptable compositions of the present invention comprise one or more compounds of the present invention in association with one or more non-toxic, pharmaceutically-acceptable carriers and/or diluents and/or adjuvants and/or excipients, collectively referred to herein as "carrier" materials, and if desired other active ingredients. The compositions may contain common carriers and excipients, such as corn starch or gelatin, lactose, sucrose, microcrystalline cellulose, kaolin, mannitol, dicalcium phosphate, sodium chloride and alginic acid. The compositions may contain crosarmellose sodium, microcrystalline cellulose, sodium starch glycolate and alginic acid.

Lubricants that can be used include magnesium stearate or other metallic stearates, stearic acid, silicon fluid, talc, waxes, oils and colloical silica.

Flavouring agents such as peppermint, oil of wintergreen, cherry flavouring or the like can also be used. It may also be desirable to add a coloring agent to make the dosage form more esthetic in appearance or to help identify the product comprising a compound of the present invention.

For oral administration, the pharmaceutical compositions are in the form of, for example, a tablet, capsule, suspension or liquid. For oral use, solid formulations such as tablets and capsules are particularly useful. Sustained released or enterically coated preparations may also be devised. Tablet binders that can be included are acacia, methylcellulose, sodium carboxymethylcellulose, polyvinylpyrrolidone (Providone), hydroxypropyl methylcellulose, sucrose, starch and ethylcellulose. For pediatric and geriatric applications, suspension, syrups and chewable tablets are especially suitable. The pharmaceutical composition is preferably made in the form of a dosage unit containing a therapeutically-effective amount of the active ingredient. Examples of such dosage units are tablets and capsules. For therapeutic purposes, the tablets and capsules can contain, in addition to the active ingredient, conventional carriers such as binding agents, for example, acacia gum, gelatin, polyvinylpyrrolidone, sorbitol, or tragacanth; fillers, for example, calcium phosphate, glycine, lactose, maize-starch, sorbitol, or sucrose; lubricants, for example, magnesium stearate, polyethylene glycol, silica or talc: disintegrants, for example, potato starch, flavoring or coloring agents, or acceptable wetting agents. Oral liquid preparations generally are in the form of aqueous or oily solutions, suspensions, emulsions, syrups or elixirs may contain conventional additives such as suspending agents, emulsifying agents, non-aqueous agents, preservatives, coloring agents and flavoring agents. Examples of additives for liquid preparations include acacia, almond oil, ethyl alcohol, fractionated coconut oil, gelatin, glucose syrup, glycerin, hydrogenated edible fats, lecithin, methyl cellulose, methyl or propyl para-hydroxybenzoate, propylene glycol, sorbitol, or sorbic acid.

For intravenous (IV) use, compounds of the present invention can be dissolved or suspended in any of the commonly used intravenous fluids and administered by infusion. Intravenous fluids include, without limitation, physiological saline or Ringer's solution.

Formulations for parental administration can be in the form of aqueous or non-aqueous isotonic sterile injection solutions or suspensions. These solutions or suspensions can be prepared from sterile powders or granules having one or more of the carriers mentioned for use in the formulations for oral administration. The compounds can be dissolved in polyethylene glycol, propylene glycol, ethanol, corn oil, benzyl alcohol, sodium chloride, and/or various buffers.

For intramuscular preparations, a sterile formulation of compounds of the present invention or suitable soluble salts forming the compound, can be dissolved and administered in a pharmaceutical diluent such as Water-for-Injection (WFI), physiological saline or 5% glucose. A suitable insoluble form of the compound may be prepared and administered as a suspension in an aqueous base or a pharmaceutically acceptable oil base, e.g. an ester of a long chain fatty acid such as ethyl oleate.

For topical use the compounds of present invention can also be prepared in suitable forms to be applied to the skin, or mucus membranes of the nose and throat, and can take the form of creams, ointments, liquid sprays or inhalants, lozenges, or throat paints. Such topical formulations further can include chemical compounds such as dimethylsulfoxide (DMSO) to facilitate surface penetration of the active ingredient.

For application to the eyes or ears, the compounds of the present invention can be presented in liquid or semi-liquid form formulated in hydrophobic or hydrophilic bases as ointments, creams, lotions, paints or powders.

For rectal administration the compounds of the present invention can be administered in the form of suppositories admixed with conventional carriers such as cocoa butter, wax or other glyceride.

Alternatively, the compound of the present invention can be in powder form for reconstitution in the appropriate pharmaceutically acceptable carrier at the time of delivery. In another embodiment, the unit dosage form of the compound can be a solution of the compound or a salt thereof in a suitable diluent in sterile, hermetically sealed ampoules.

The amount of the compound of the present invention in a unit dosage comprises a therapeutically-effective amount of at least one active compound of the present invention which may vary depending on the recipient subject, route and frequency of administration. A recipient subject refers to a plant, a cell culture or an animal such as an ovine or a mammal including a human.

According to this aspect of the present invention, the novel compositions disclosed herein are placed in a pharmaceutically acceptable carrier and are delivered to a recipient subject (including a human subject) in accordance with known methods of drug delivery. In general, the methods of the invention for delivering the compositions of the invention in vivo utilize art-recognized protocols for delivering the agent with the only substantial procedural modification being the substitution of the compounds of the present invention for the drugs in the art-recognized protocols.

Likewise, the methods for using the claimed composition for treating cells in culture, for example, to eliminate or reduce the level of bacterial or fungal contamination of a cell culture, utilize art-recognized protocols for treating cell cultures with antibacterial or antifungal agent(s) with the only substantial procedural modification being the substitution of the compounds of the present invention for the agents used in the art-recognized protocols.

The compounds of the present invention provide a method for treating bacterial infections, fungal infections and pre-cancerous or cancerous conditions. As used herein the term unit dosage refers to a quantity of a therapeutically-effective amount of a compound of the present invention that elicits a desired therapeutic response. As used herein the phrase therapeutically-effective amount means an amount of a compound of the present invention that prevents the onset, alleviates the symptoms, or stops the progression of a bacterial infection, fungal infection or pre-cancerous or cancerous condition. The term treating is defined as administering, to a subject, a therapeutically-effective amount of at least one compound of the present invention, both to prevent the occurrence of a bacterial or fungal infection or pre-cancer or cancer condition, or to control or eliminate a bacterial or fungal infection or pre-cancer or cancer condition. The term desired therapeutic response refers to treating a recipient subject with a compound of the present invention such that a bacterial or fungal infection or pre-cancer or cancer condition is reversed, arrested or prevented in a recipient subject.

The compounds of the present invention can be administered as a single daily dose or in multiple doses per day. The treatment regime may require administration over extended periods of time, e.g., for several days or for from two to four weeks. The amount per administered dose or the total amount administered will depend on such factors as the nature and severity of the infection, the age and general health of the recipient subject, the tolerance of the recipient subject to the compound and the type of the bacterial or fungal infection, or type of cancer.

A compound according to this invention may also be administered in the diet or feed of a patient or animal. The diet for animals can be normal foodstuffs to which the compound can be added or it can be added to a premix.

The compounds of the present invention may be taken in combination, together or separately with any known clinically approved antibiotic, anti-fungal or anti-cancer to treat a recipient subject in need of such treatment.

Compounds of Formula I are obtained biosynthetically by culturing *Actinomycetes* species in growth media described in Table 4, at temperatures between 24° C.-34° C. and with shaking to aerate of the culture medium for 3 to 40 days. The compounds of Formula I are extracted and isolated from the bacterial culture by methods known to a skilled person including centrifugation, chromatography, adsorption, filtration, extraction or other methods of separation.

The compounds of Formula I may be biosynthesized by various microorganisms. Microorganisms that may synthesize the compounds of the present invention include but are not limited to bacteria of the order Actinomycetales, also referred to as *actinomycetes*. Non-limiting examples of members belonging to the genera of Actinomycetes include Nocardia, Geodermatophilus, Actinoplanes, Micromonospora, Nocardioides, Saccharothrix, Amycolatopsis, Kutzneria, Saccharomonospora, Saccharopolyspora, Kitasatospora, Streptomyces, Microbispora, Streptosporangium, Actinomadura. The taxonomy of actinomycetes is complex and reference is made to Goodfellow (1989) Suprageneric classification of actinomycetes, Bergey's Manual of Systematic Bacteriology, Vol. 4, Williams and Wilkins, Baltimore, pp 2322-2339, and to Embley and Stackebrandt, (1994), and The molecular phylogeny and systematics of the actinomycetes, Annu. Rev. Microbiol. 48, 257-289 (1994), for genera that may synthesize the compounds of the invention, incorporated herein in their entirety by reference.

Microorganisms biosynthetically producing compounds of Formula I are cultivated in culture media containing known nutritional sources for actinomycetes having assimilable sources of carbon, nitrogen plus optional inorganic salts and other known growth factors at a pH of about 6 to about 9, non-limiting examples of growth media are provided in Table 4 below. Microorganisms are cultivated at incubation temperatures of about 20° C. to about 40° C. for about 3 to about 40 days.

The culture media inoculated with the microorganisms which biosynthetically produce compounds of Formula I, may be aerated by incubating the inoculated culture media with agitation, for example shaking on a rotary shaker, or a shaking water bath. Aeration may also be achieved by the injection of air, oxygen or an appropriate gaseous mixture to the inoculated culture media during incubation.

After cultivation and production of compounds of Formula I, the compounds can be extracted and isolated from the cultivated culture media by techniques known to a skilled person in the art and/or disclosed herein, including for example centrifugation, chromatography, adsorption. For example, the cultivated culture media can be mixed with a suitable organic solvent such as n-butanol, n-butyl acetate and 4-methyl-2-pentanone, the organic layer can be separated for example, by centrifugation followed by the removal of the solvent, by evaporation to dryness or by evaporation to dryness under vacuum. The resulting residue can optionally be reconstituted with for example water, ethanol, ethyl acetate, methanol or a mixture thereof, and re-extracted with a suitable organic solvent such as hexane, carbon tetrachloride, methylene chloride or a mixture thereof. After removal of the solvent, the compound of

TABLE 4

Examples of Growth Media for Production of Compounds of Formula I

| Component | VA | QB | GA*[4] | MA | NA | KH | OA | HA | RM | EA | KA | CA |
|---|---|---|---|---|---|---|---|---|---|---|---|---|
| pH*[5] | 7 | 7.2 | | 7.5 | 7 | 7 | 7 | | 6.85 | 7 | 5.7 | 7 |
| Glucose | 50 | 12 | 10 | | | 10 | 10 | 10 | 10 | 5 | 10 | 10 |
| Sucrose | | | 103 | | | | | 340 | 100 | | | |
| Lactose | | | | | | | | | | 50 | | |
| Cane molasses | | | | | 10 | | | | | | | 15 |
| Soluble starch | | 10 | | 25 | | | | | | | | |
| Potato dextrin | | | | | | 20 | | | | | | 40 |
| Corn steep | | | | | | | | | | 5 | | |
| Corn steep | | 5 | | | | | 3 | | | | 10 | |
| Dried yeast | | | | 2 | | | | | | 5 | | |
| Yeast extract | | | 5 | | | 5 | 3 | 3 | 5 | | | |
| Malt extract | | | | | | | | 3 | 3 | | | |
| Pharmamedia ™ | | 10 | | | | | | | | | | |
| Glycerol | | | | | 20 | | 5 | | | 15 | 5 | |
| NA-Amine A | | | | | | 5 | | | | | | 10 |
| Soybean | | | | 15 | | | | | | | 10 | |
| Soybean flour | 30 | | | | | | | | | 10 | | |
| Beef extract | | | | | | | 3 | | | | | |
| Bacto-peptone | | | | | 1 | | | 5 | | 5 | | |
| MgSO$_4$.7H$_2$O | | | | | | | | | | 0.5 | | 1 |
| MgCl$_2$.6H$_2$O | | | 10.12 | | | | | | | | | |
| CaCO$_3$ | 6 | | | 4 | 4 | 1 | 2 | | | 3 | 2 | 2 |
| NaCl | 5 | | | | 5 | | | | | | 5 | |
| (NH$_4$)$_2$ SO$_4$ | 3 | | | | 2 | | | | | 2 | | |
| K$_2$ SO$_4$ | | | 0.25 | | | | | | 0.25 | | | |
| MnCl$_2$.4H$_2$O | | | | | | | | | | 0.1 | | |
| MgCl$_2$.6H$_2$O | | | | | | | | 1 | 10 | | | |
| FeCl$_2$.4H$_2$O | | | | | | | | | | 0.1 | | |
| ZnCl$_2$ | | | | | | | | | | 0.1 | | |
| Thiamine | | | | | | | 0.1 | | | | | |
| Casamino acid | | | 0.1 | | 5 | | | | 0.1 | | | |
| Proflo oil | | 4 | | | | | | | | | | |
| MOPS | | | | | | | | | 21 | | | |
| Trace element solution*[3] ml/L | | | | | | | | | 2 | | | |

Unless otherwise indicated all the ingredients are in gm/L
*[3]Trace elements solution contains: ZnCl$_2$ 40 mg; Fe Cl$_3$ 6H$_2$O (200 mg); CuCl$_2$ 2H$_2$O (10 mg); MnCl$_2$.4H$_2$O; Na$_2$B$_4$O$_7$.10H$_2$O (10 mg); (NH$_4$)$_6$ Mo$_7$O$_{24}$.4H$_2$O (10 mg) per litre.
*[4]Dissolve components in 800 ml water and autoclave, later add: 10 ml KH$_2$PO$_4$ (0.5% solution); 80 ml CaCl$_2$.2H$_2$O (3.68% solution); 15 ml L-proline (20% solution); 100 ml TES buffer (5.73% solution, pH 7.2); 5 ml NaOH (1N solution), and 2 ml of trace elements solution.
*[5]The pH is to be adjusted as marked prior to the addition of CaCO$_3$ in those media containing it.

Formula I can be further purified by the use of standard techniques such as chromatography.

The compounds of Formula I that are biosynthesized by microorganisms may optionally be subjected to random and/or directed chemical modifications to form compounds that are derivatives or structural analogs of compounds of Formula I. Derivatives or structural analogs of compounds of Formula I having similar functional activities are within the scope of the present invention. Compounds of Formula I may optionally be modified using methods known in the art and described herein.

Unless otherwise indicated, all numbers expressing quantities of ingredients and properties such as molecular weight, reaction conditions, $IC_{50}$ and so forth used in the specification and claims are to be understood as being modified in all instances by the term "about". Accordingly, unless indicated to the contrary, the numerical parameters set forth in the present specification and attached claims are approximations. At the very least, and not as an attempt to limit the application of the doctrine of equivalents to the scope of the claims, each numerical parameter should at least be construed in light of the number of significant figures and by applying ordinary rounding techniques.

Notwithstanding that the numerical ranges and parameters setting forth the broad scope of the invention are approximations, the numerical values set in the examples, Tables and Figures are reported as precisely as possible. Any numerical values may inherently contain certain errors resulting from variations in experiments, testing measurements, statistical analyses and such.

The compounds of Formula I, Formula II and compound 2(a) may optionally be chemically modified using methods known in the art and described herein.

The compounds of the invention are made by biofermentation and well-known chemical schemes. The schemes described herein are exemplary, any chemical synthetic process known to a person skilled in the art providing the structures described herein, may be used and are therefore comprised in the present invention.

SCHEME 1 Acylation Reactions

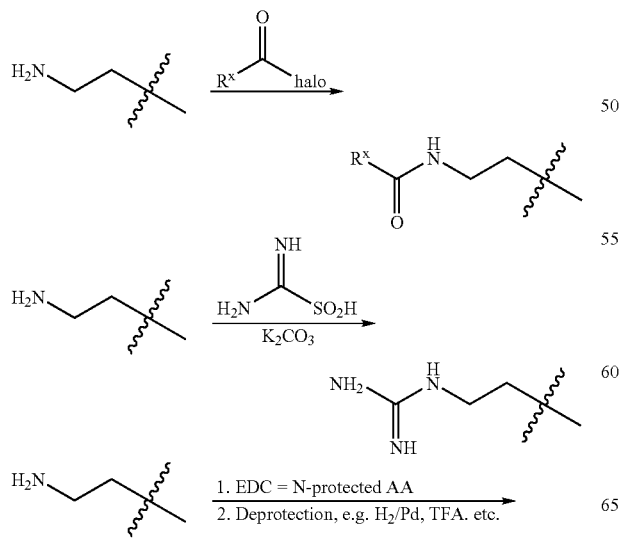

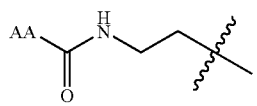

EDC = 1-ethyl-3-(3-dimethylaminopropyl)-carbodiimide
Proctective groups include N-benzyloxycarbonyl (CBZ), N-butoxycarbonyl (BOC), N-fluoren-9-ylmethoxycarbonyl (FMOC)
$R^x$ represents $C_{1-6}$ alkyl, $C_{2-6}$ alkenyl, aryl or heteroaryl
AA represents a naturally occurring amino acid Scheme 2. Aminations/reductive aminations of terminal nitrogen

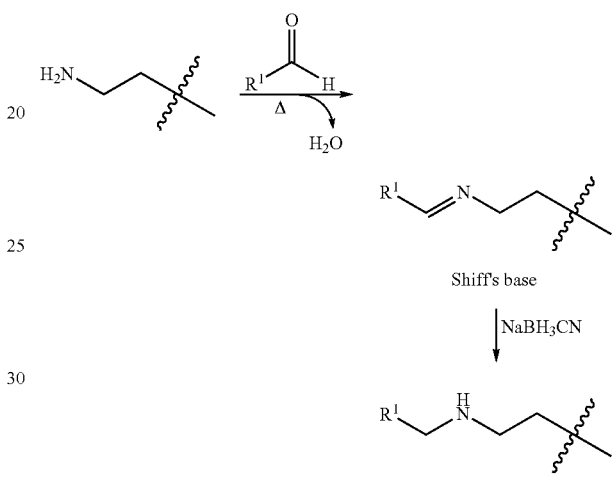

$R^1$ as previously defined

Scheme 3. Olefin reactions

Scheme 4. Ketone reactions

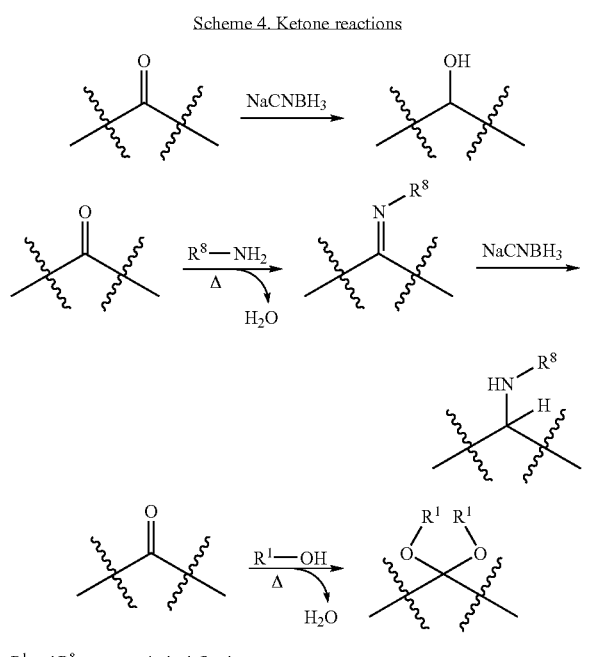

R¹ and R⁸ are as previusly defined

Scheme 5. O-Reactions

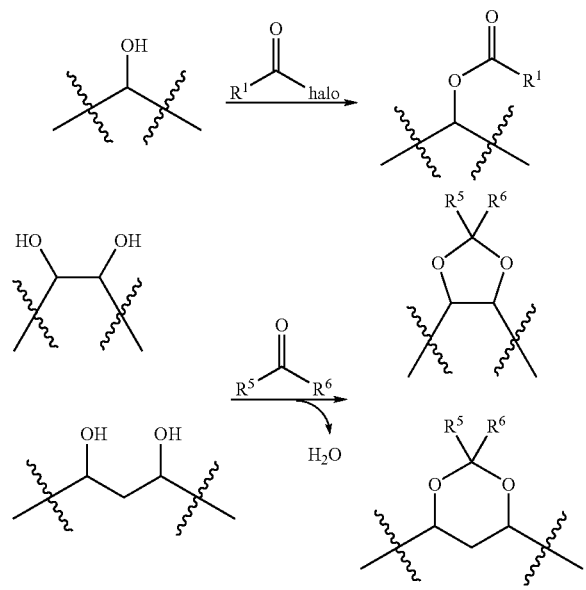

R¹, R⁵ and R⁶ are as previously defined

Scheme 6. Hydrolysis/Esterification

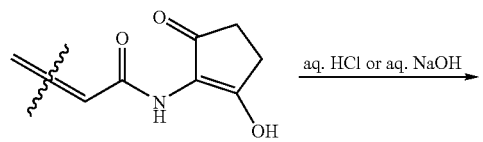

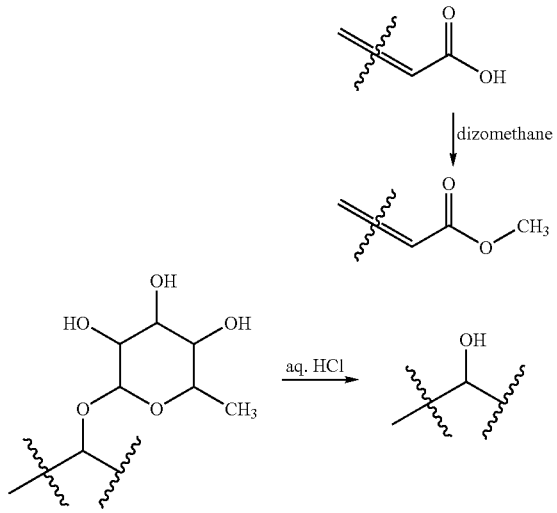

Scheme 1 is used to obtain Compounds 2(m), 2(n), 2(o), 2(p), 2(q), 2(r), 2(s), 2(t), 2(u), 2(v), 2(w), 2(x), 2(y), 2(z), 2(aa), and 2(ab) from Compound 2(a).

Scheme 3 is used to obtain Compound 2(b) from Compound 2(a).

Scheme 4 is used to obtain Compounds 2(c), 2(d), 2(e) and 2(f) from Compound 2(a).

Scheme 6 is used to obtain Compounds 2(g), 2(h), 2(i) and 2(j) from Compound 2(a).

EXAMPLE 1

Production of Compound 2(a) by Fermentation

EXAMPLE 1(A)

Preparation of Strain [C03U03]023

Strain [C03]023: *Streptomyces aizunensis* NRRL B-11277 was plated on three tomato paste oatmeal agar (ATCC medium 1360) plates for sporulation at 28° C. The plates were incubated for a period of 5-7 days, after which spores were collected from each plate into 5 ml sterile distilled water, spun down by centrifugation at 5000 rpm (10 min), and dispersed in 20 ml sterile water. After a second centrifugation under the same conditions the pellet was resuspended in 10 ml sterile distilled water. A series of ten-fold dilutions of the original spore suspension were prepared and 0.5 ml aliquots plated on tomato paste-oat meal agar until sporulation occurred (5-7 days). Each individual clone from the plates with single well-isolated colonies (generated from $10^{-8}$ to $10^{-10}$ dilutions of the spore suspension) was chosen and transferred to one plate of tomato paste-oat meal agar to generate spores for storage. Each clone was grown in 25×150 mm glass tubes for its production of Compound 2(a). A total of 385 clones were tested for production levels of Compound 2(a). Clone [C03]023 showed a production of 3 times better than the wild-type strain. This clone was chosen, stored, and used for mutagenesis.

Strain [C03U03]023: An aqueous spore suspension of [C03]023 was mutagenized by UV radiation (254 nm) at different energy levels (expressed as mJoules per surface area). Clone [C03U03]023 obtained at 0.4 mJ/1 cm² showed slightly more than three times better production than the parent clone [C03]023. Production of Compound 2(a) by the new clone has been consistently reproducible both in shaken flask (500 ml medium QB or VA in 2-L baffled flasks) and in 100-L fermentors with medium VA.

EXAMPLE 1(B)

Activation of Lyophilized Sample of Strain [C03U03]023

Strain [C03U03]023 was provided as a lyophilized pellet. The lyophilized sample was opened under aseptic conditions, and 0.3-0.5 ml of medium ITSB was added to the sample to make a cell suspension. The cell suspension was transferred to 25 ml of medium ITSB (described below) in a 125-ml flask to form a liquid culture. The liquid culture was incubated at 28° C. for 3-5 days until visible growth occurred. Purity of the culture was tested by streaking a loop on ISP2 agar plate.

EXAMPLE 1(C)

Preparation and Storage of Glycerol Stocks of Strain [C03U03]023

Strain [C03U03]023 was grown for 7-10 days at 28° C. on several tomato paste-oat meal agar plates. Surface growth was collected from each plate into 5 ml sterile distilled water, spun down by centrifugation at 5000 rpm (10 min), and dispersed in 10 ml sterile water. After a second centrifugation under the same conditions the pellet was resuspended in 2 ml sterile 25% glycerol and 0.5-ml aliquots were stored at −80° C. in screw-capped vials. In addition to the glycerol stocks, the collected cell mass could be resuspended in 15% sterile skim milk and dispensed in 0.5-ml aliquots into glass ampoules and lyophilized following standard procedures.

EXAMPLE 1(D)

Preparation of Seed Culture

A vial containing frozen mycelia prepared as described in Example 1(C) was taken out of freezer and kept on dry ice. Under aseptic conditions, a loopfull of the frozen culture was taken and streaked on the surface of tomato paste-oat meal agar plate and incubated at 28° C. until vegetative mycelium appeared (5-7 days). In order to start the seed culture, 2-3 loopfull of the surface growth obtained from the tomato paste-oat meal agar plate was transferred to a 1.5-ml Eppendorf tube containing 300 µl of medium ITSB. The mycelium with agar fragments was homogenized, and 1 ml of medium ITSB was added to the suspension. The content was used to inoculate two 125-ml flasks containing 25 ml of sterile medium ITSB. The flasks were incubated at 28° C. for 65-70 hours in a rotary shaker at 250 rpm. This seed culture was then used to inoculate production medium QB or VA.

EXAMPLE 1(E)

Production of Compound 2(a) by Fermentation

A sample of the seed culture prepared as described in Example 1(D) above was checked microscopically for any possible contamination. A sample of the seed culture was then streaked onto one ISP2 plate (control plate) and incubated at 28° C. From the seed culture under aseptic conditions, 10 ml was taken and used to inoculate each 2 Liter baffled flask containing 500 ml of sterile medium QB or VA. The fermentation batches were incubated aerobically with shaking (250 rpm) at 28° C. for a period of 7 days. After 3-5 days of incubation the control plate was checked for purity of the culture.

The compositions of the growth media used in Examples 1(A)-1(E) are given below. Note that either of Production media QB or VA may be used in the production of Compound 2(a); however, production medium VA is preferred when conducting the fermentation on a large scale.

| Seed Medium ITSB: | |
|---|---|
| Trypticase Soy Broth (Difco) | 30 g |
| Yeast extract (Sigma) | 3 g |
| $MgSO_4$ (Sigma) | 2 g |
| Glucose (Sigma) | 5 g |
| Maltose (Sigma) | 4 g |
| Distilled water | 1 L |
| Production Medium VA | |
| Glucose | 50 g |
| Soybean Flour | 30 g |
| $CaCO_3$ | 6 g |
| NaCl | 5 g |
| $(NH_4)_2SO_4$ | 3 g |
| Distilled water | 1 L |
| Production Medium QB: | |
| Soluble starch (Sigma) | 10 g |
| Glucose (Sigma) | 12 g |
| Pharmamedia (Traders protein) | 10 g |
| Corn steep liquor (Sigma) | 5 g |
| Proflo oil (Traders Protein) | 4 mL * |
| Distilled water | 1 L |
| Tomato paste Oatmeal Agar: | |
| Baby Oatmeal Food (Heinz) | 20 g |
| Tomato Paste | 20 g |
| Agar | 15 g |
| Tap water | 1 L |
| pH7.0 | |

* Adjust pH to 7.2, then add Proflo oil

The production of Compound 2(a) may also be carried out in the production media having the compositions as indicated in Table 4, supra, in order of preference.

EXAMPLE 2

Isolation of Compound 2(a)

Thirty minutes prior to harvest of Compound 2(a) from the fermentation broth of the baffled flasks of Example 1E, regenerated, water-washed, Diaion HP-20® in a quantity of wet-packed volume equal to 12% of the initial fermentation beer volume was added to the whole fermentation broth of Example 1E and modest agitation was continued for 30 minutes. At harvest the fermentation broth from 2×500 ml flasks was centrifuged and the supernatant was decanted from the resin and mycelia pellet. The pellet was resuspended in 15% MeOH in water (half the original fermentation beer volume), agitated mildly and recentrifuged, and the surpernatant was decanted from the residue. The residue was washed a second time in the same manner with another 15% MeOH in water, followed by a single final wash with methanol:water (7:3 v/v) (half the original fermentation beer volume) to obtain a well-washed residue. The well-washed mycelia:resin residue was extracted three times with 100% ethanol, each extract being at 20% original beer volume. The three extracts were combined and concentrated under vacuum on a rotary evaporator, to dryness.

The three extracts (representing material from 2×500 ml flasks) were combined, filtered on paper and concentrated under vacuo to remove organic solvents. The resulting semi-solid residue (aqueous suspension) of crude Compound 2(a) represented greater than 90% of the respective compounds produced and was about 25% pure. The aqueous suspension was freeze-dried overnight to give 460 mg of a dark brown solid. The solid was stirred with 10 ml of methanol and centrifuged for 2 minutes to remove insoluble matter.

The semi-solid residue of crude Compound 2(a) was then purified using a Waters Xterra® preparative MS C-18 column with 10 μm packing of dimensions 19 mm diameter× 150 mm length, using the following gradient table (Table 5) from 5 mM aqueous ammonium bicarbonate to acetonitrile.

TABLE 5

| Time (min) | % Aqueous | % Acetonitrile |
|---|---|---|
| 0 | 70 | 30 |
| 5 | 45 | 55 |
| 10 | 70 | 30 | determined by electrospray mass spectrometry to be 1297 (FIG. 13) and the UV $\lambda_{max}$ were found to be 319, 333, 350 (FIG. 14). The NMR data were collected at 500 MHz with the compound 2(a) dissolved in MeOH-d4, and included proton (FIG. 15A), carbon-13 (FIG. 15B), and multidimensional pulse sequences gDQCOSY, gHSQC, gHMBC, and TOCSY (FIGS. 15C, 15D, 15E and 15F, respectively).

Streptomyces aizunensis NRRL B-11277 was grown on oat meal agar plates for 5-7 days. The surface growth was collected and washed with water, and DNA was extracted following standard procedures (T. Kiesser et al. Practical Streptomyces Genetics, The John Innes Foundation, Norwich, UK, 2000). The genomic library was produced in cosmid and plasmid vectors, and the genome was scanned for the presence of gene sequence tags (GSTs) related to the biosynthesis of secondary metabolites as described in E. Zazopoulos et al., Nature Biotechnology 21:187-190 (2003). The GSTs were used to isolate cosmids containing the compound 2(a) locus. The PKS system found within the compound 2(a) locus was determined to contain 9 PKS genes containing 27 modules. (The analysis of this PKS system is fully described elsewhere herein; see, e.g., Table III and accompanying text). Full analysis of the PKS and associated genes led to the prediction of a structure of Formula 1 below.

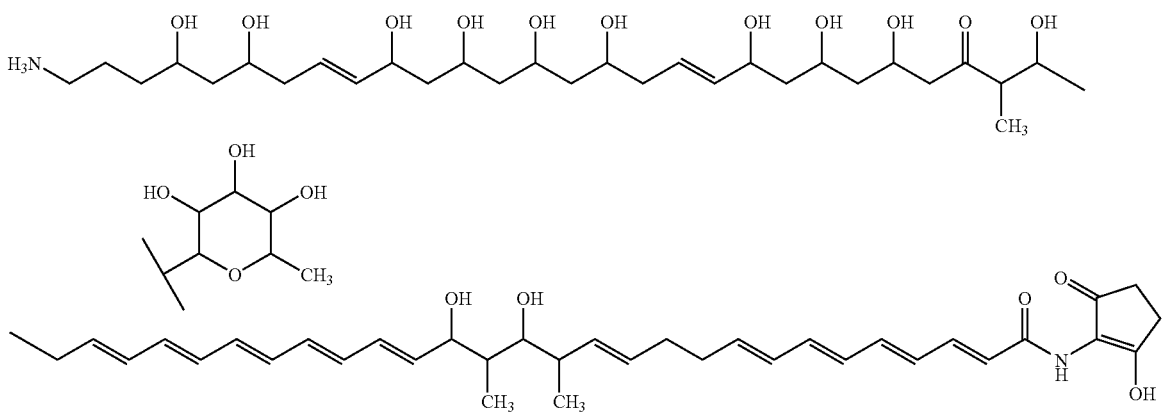

1

The eluate was monitored at 390 nm, a single run was loaded with 23 mg of crude residue in 0.5 ml of methanol, and a conservative cut of the peak eluting at 3.4 minutes afforded compound 2(a). Nineteen runs were conducted to yield 33 mg of product with about 95% purity.

EXAMPLE 3

Structural Determination of Compound 2(a)

The structure of compound 2(a) was determined by a combination of genomic information and spectroscopic data, including Mass, UV, and NMR spectroscopy. The Mass was The position of the glycosidic linkage to the sugar moiety could not be determined by the genomic analysis; however, the positioning of the aminohydroxycyclopentenone unit was determined by analogy with its placement in other actinomycete metabolites (Colabomycin A from Streptomyces griseoflavus Tue 2880, J. Antibiot. 1988, 41, 1178-85, 1186-1195 or Enopeptin-A from Streptomyces griseus, Osada et al., J. Antibiot. 44, 1463-6 1991).

To obtain expression of these genes; and the end product of this biosynthesis pathway, S. aizunensis NRRL B-11277 was grown in several different media designed for the production of secondary metabolites in shaken flasks. At harvest the broth was diluted with an equal volume of methanol to induce cell lysis, and the diluted, clarified broth was concentrated 10 fold. An aliquot (50 μL) from the concentrate from each medium was chromatographed on a Waters Xterra C-18 HPLC column (19×150 mm) at a flow rate of 1 mL/min and monitored by diode array detector (DAD) UV and positive and negative ion MS. Fractions (800 µL) were collected and tested for antimicrobial activity against a panel of indicator strains. From the extracts of several different media, HPLC fractions in the number 39 to 45 region exhibited strong activity against *Candida albicans* and this correlated with a UV absorption $\lambda_{max}$ 319, 333, and 351 nm, and with strong MS peaks at m/z 1298 (positive ion mode) and 1296 (negative ion mode). These physical characteristics were entirely consistent with a metabolite of formula 1.

A high yielding medium was chosen and the organism was regrown on a 2-liter scale. The compound 2(a) was extracted from the mycelial pellet with methanol and acetone, and from the broth with Diaion HP-20® resin, from which it was recovered with methanol after the resin had been washed with methanol/water 3:2. The crude extracts were purified by HPLC on a Waters Xterra C-18 column (19×150 mm) using an aqueous (5 mM ammonium bicarbonate)/acetonitrile gradient.

Compound 2(a), a yellow solid of MW 1297 Da ($C_{70}H_{108}N_2O_{20}$ requires 1296.75) $\lambda_{max}$ 319, 334, and 351 nm was the subject of a series of 1D and 2D NMR measurements including a CMR, $^1$H-NMR, gDQCOSY, gHSQC, gHMBC, TOCSY, gHSQCTOXY, and several 1D TOCSY experiments. See FIGS. 15A-15E. Analysis of these spectra led to the assignments shown for compound 2(a) in FIG. 17. Although considerable overlap of signals rendered unambiguous assignments of all of the signals to specific protons and carbons impractical, those that could be made unambiguously confirmed the structure predicted from the genomics. A major cross peak in the gHMBC spectrum between the well separated proton resonance at 4.01 ppm and the anomeric carbon at 102.6 ppm placed the sugar as shown, as this proton falls within a 14 carbon section of the major chain with fully assigned carbon and proton signals. A well resolved carbon spectrum with high signal to noise ratio showed that the unassigned methylene carbons were at 42.0, 45.3, 45.4 and 46.6 ppm. Analysis by gHSQC indicates that that these were attached to protons at 2.24, 1.62, 1.50 and 1.68, and 1.55 ppm respectively. Similarly the unassigned carbinols at 66.2, 66.2 (resolved), 67.2 and 69.0 ppm attached to protons at 4.06, 4.08, 4.22 and 3.89 ppm respectively and the unassigned olefinic carbons at 129.1, 131.0, 131.9, 133.3, 133.7, 134.3, 134.8, 136.5, and 138.0 ppm attached to protons at 5.72, 5.72, 6.28, 6.25, 6.28, 6.25, 6.19, 5.53, and 5.86 respectively. The aminohydroxycyclopentenone signals were not straightforward and reflected the tautomeric equilibrium of this moiety. The upfield methylene signal and the downfield carbonyl signals were only 10% of the intensity of those from the other tautomer. The signal from C-1 of this moiety was not detected, a phenomenon which has been previously ascribed to tautomerization for the same structural unit. See, He, H.; Shen, B.; Korshalla, J.; Siegel, M. M.; Carter, G. T. *J. Antibiot.* 2000, 53,191-195.

EXAMPLE 4

Minimal Inhibitory Concentration (MIC) Determination for Compound 2(a)

The MIC determination for fungal and bacterial organisms was performed using the broth microdilution assay adapted from National Committee for Clinical Laboratory Standards (NCCLS) M27-A (Vol.17 No. 9,1997 ), Reference Method for Broth Dilution Antifungal Susceptibility Testing of Yeasts; Approved Standard guidelines: M23-A: Reference Method for Broth Dilution Antifungal Susceptibility Testing of Filamentous Fungi; Approved Standard, vol. 22, No. 16.

Materials:
1) Overnight broth cultures of bacterial and fungal strains to be tested;
2) Stock solution of Compound 2(a) at 3.2 mg/ml in DMSO;
3) Standard 96 well round-bottom plates, sterile;
4) Cation adjusted Mueller-Hinton broth, or Brain Heart Infusion broth (for antibacterial testing);
5) Morpholinepropanesulfonic acid (MOPS)-buffered RPMI-1640 medium (for antifungal testing);
6) Sterile isotonic saline (0.85%);
7) McFarland 0.5 Barium Sulfate Turbidity Standard at 100×3.2 mg/ml.

Test compound preparation: The test article was prepared as 100× stock solutions in DMSO, with concentrations ranging from 3.2 mg/ml to 0.0625 mg/ml (a two-fold dilution series over 10 points). The first dilution (3.2 mg/ml) was prepared by resuspending 0.5 mg of each test article in 156.25 µl of DMSO. The stock is then serially diluted by two-fold increments to obtain the desired concentration range.

Inoculum preparation: For fungal strains, the inoculum was prepared as follows. From an overnight culture in Yeast Media broth, cell density was adjusted in 0.85% saline to 0.5 McFarland. This procedure yielded a stock suspension of about $5\times10^6$ cells/ml. Following thorough vortexing, a working suspension was prepared by diluting the stock 1:50 in RPMI 1640, and then further diluting it 1:20 with RPMI 1640 to obtain the 2× test inoculum (about $5\times10^3$ cells/ml). For filamentous fungi, the inoculum was prepared as follows. From a spore suspension kept at 4° C., an appropriate dilution in 0.85% saline was made to obtain a final optical density 600 between 0.09-0.11. A working suspension was then prepared by diluting the spore suspension 50 times in RPMI to obtain the 2× test inoculum (about 1×105 CFU/ml).

MIC Determination: The 100× test article solutions were diluted 50 times in RPMI 1640, MH or BHI media and dispensed in a 96 well plate, one concentration per column, 10 columns in total. The 11th column contained RPMI 1640 with 1% DMSO with cells, the 12th column contained 100 µl of RPMI 1640 alone.

50 µl of the final cell dilution (yeast, filamentous fungi or bacteria) of each indicator strain was added to each corresponding well of the microplate containing 50 µl of diluted drug or media alone. Assay plates were incubated at 35° C. for up to 72 hrs. MIC readings were determined at 24 and 48 hrs for the *Candida* and *Aspergillus* species, and at 48 and 72 hrs for *Cryptococcus neoformans*. MIC readout for each indicator was determined as the lowest concentration of test compound resulting in total absence of growth.

TABLE 6

MIC (µg/ml) for Compound 2(a) for various strains of yeast and fungi

| Yeasts and filamentous fungi | MIC (µg/ml) | |
|---|---|---|
| | 24 hrs | 48 hrs |
| *Candida albicans* ATCC 10231 | 4 | 4 |
| *Candida krusei* LSPQ 0309 | 8 | 8 |

TABLE 6-continued

MIC (µg/ml) for Compound 2(a) for various strains of yeast and fungi

| Yeasts and filamentous fungi | MIC (µg/ml) | |
|---|---|---|
| | 24 hrs | 48 hrs |
| Candida glabrata LSPQ 0250 | 4 | 8 |
| Candida lusitaniae ATCC 200953 | 4 | 4 |
| Saccharomyces cerevisiae ATCC 9763 | 4 | 4 |
| Cryptococcus neoformans ATCC 32045 | 2* | 4** |
| Aspergillus flavus ATCC 204304 | 4 | 8 |
| Aspergillus fumigatus ATCC 204305 | 16 | 16 |

*48 hrs reading;
**72 hrs reading

EXAMPLE 5

In Vitro Activity of Compound 2(a) Against *Aspergillus* Species

To determine the antifungal activity of compound 2(a) against *Aspergillus* species (*A. fumigatus* and *A. flavus*) a disk diffusion assay was used to determine the minimum effective concentration (MEC) as described by Wong G K, Griffith S, Kojima I and Demain A L. Antifungal activities of rapamycin and its derivatives, prolylrapamycin, 32-desmethylrapamycin, and 32-desrmethoxyrapamycin. J. Antibiotics, 51(5): 487-491,1998. Such assay is commonly used to reveal activity of antifungal drugs against filamentous fungi such as *Aspergillus* sp. (Arikan S, Yurdakul P, Hascelik G. Comparison of two methods and three end points in determination of in vitro activity of micafungin against *Aspergillus* spp. *Antimicrobial Agents and Chemotherapy* 47(8): 2640-2643, 2003).

Preparation of the inoculum: After spreading on YM agar (in cell culture flasks), *Aspergillus* strains (*A. flavus*—ATCC 204304 and *A. fumigatus*—LSPQ 204305) were left sporulating for 4 to 5 days at 35° C. After the addition of 10 to 20 ml of saline solution (0.85% NaCl), spores were collected by gently rubbing the surface of the conidiophores with a disposable inoculation loop. *Aspergillus* spore suspensions, kept at 4° C., were used as the inoculum for the disc assays.

Preparation of the disks: Stock solutions (5 mg/ml) in methanol and dilutions (0.25, 0.5, 1.0, 2.5, 5.0, 7.5, 10.0 and 50.0 µg/ml), prepared by serial dilutions of stock solution in methanol were prepared for the test article and each of the control compounds. Itraconazole and casponfungin were used as positive controls while fluconazole or DMSO alone were used as negative controls. Drug-containing disks were prepared by spotting of 10 µl of the proper drug solution (or methanol as control) onto filter disks that were then allowed to air-dry.

Agar plate preparation: *Aspergillus* spore suspensions were adjusted to about 81% of transmittance at 530 nm in saline solution. 200 µl of the adjusted inoculum was then mixed with 50 ml of melted 0.8% YM agar (cooled to ~50° C.), mixed thoroughly and poured in a 150 mm Petri dish. Once the agar was set, the prepared filters were loaded onto the plates, which were incubated at 35° C. The zone of inhibition (ZOI) of fungal growth was measured after 24 hours of incubation.

Results: Data presented in Table 7 show the lowest concentration (MEC) inducing inhibition of the fungal growth and the corresponding ZOI obtained at this concentration for compound 2(a) and the controls. Results demonstrated that compound 2(a) was active against *Aspergillus fumigatus* and *Aspergillus flavus*. Similar effect was obtained for itraconazole and caspofungin while fluconazole was inactive.

TABLE 7

| | Aspergillus fumigatus | | Aspergillus flavus | |
|---|---|---|---|---|
| | MEC (µg/ml) | ZOI (mm) | MEC (µg/ml) | ZOI (mm) |
| Methanol | 0 | 0 | 0 | 0 |
| Compound 2(a) | 2.5 | 2.7 | 2.5 | 2.7 |
| Itraconazole | 1.0 | 1.7 | 0.5 | 1.7 |
| Casponfungin | 2.5 | 0.7 | 2.5 | 0.7 |
| Fluconazole | 0 | 0 | 0 | 0 |

MEC: mimimum effective concentration
ZOI: zone of inhibition of fungal growth calculated for each MEC

EXAMPLE 6

Evaluation of Antifungal Activity of Compound 2(a) in a Mouse Model of Disseminated Candidiasis Compound 2(a) was provided as a dry powder with an estimated purity of 95+%. Fungizone (amphotericin B desoxycholate, to be used as a comparitor), was also provided as a dry powder with an estimated purity of 95+%. The compound 2(a) and Fungizone were stored as dry powders at −80° C. until the day of administration.

Female mice (species *Mus musculus*, strain CD-1, Charles River) with body weight range of 22-24 g were used in the study. The animals were observed for 3 days before treatment. All animal experiments were performed at the Ste-Justine Hospital (Montreal, Quebec) according to ethical guidelines of animal experimentation of the ethical committee of the hospital. During the study, dead or apparently sick animals were promptly removed and sick mice were euthanized upon removal from the cage.

The animals were maintained in rooms under controlled conditions of temperature (23±2° C.), humidity (45±5%), photoperiodicity (12 hrs light/12 hrs dark) and air exchange. The animals were housed in polycarbonate cages (4/single cage) equipped to provide food and water. Sterile wood shavings were used for animal bedding and the bedding was replaced every other day. Food (Harlam Tecklab, Canada) and autoclaved tap water was provided ab libitum, the food being placed in the metal lid on top of the cage. Water bottles were equipped with rubber stoppers and sipper tubes and were cleaned, sterilized and replaced once a week.

Six groups of mice (10 mice per group) were infected intravenously with $3 \times 10^6$ CFU of *C. albicans* SC5314 as previously described (see Dubois, N., et al., *Microbiology* 1998, 144: 2299-2310). Twenty-four hours after infection, each individual group of mice was treated with Compound 2(a) (1 or 3 mg/kg i.p.), Fungizone (0.25, 0.5 or 1 mg/kg i.p.) as comparitor, or sham-treated with sterile water containing 5% dextrose and 3% DMSO. Each animal received 100 µl of test solution.

The treatment regimen was repeated once daily for a total of 4 days. The mice were observed twice daily for signs of morbidity over 21 days. Moribund animals were scored as non-survivors and euthanized by $CO_2$ inhalation. The Kaplan and Meier product limit estimate was used to analyze survival data and plot the survival function.

TABLE 8

Survival Rates Over Time After Inoculation with Compound 2(a) and Fungizone

| Groups | Treatment | Dose (mg/kg) | Median survival |
|---|---|---|---|
| 1 | Vehicle | — | 5 days |
| 2 | Compound 2(a) | 1.0 | 8.5 days |
| 3 | Compound 2(a) | 3.0 | 20 days |
| 4 | Fungizone | 0.25 | >21 days |
| 5 | Fungizone | 0.5 | >21 days |
| 6 | Fungizone | 1.0 | >21 days |

As indicated in Table 8, compound 2(a) has in vivo antifungal activity similar to a dose of 0.25 mg/kg of Fungizone and increases 4-fold the median survival time of infected mice.

The data (percent survival versus days post-inoculation) was plotted; the resulting graph is shown in FIG. 16.

EXAMPLE 7

In Vitro Antitumor Activity of Compound 2(a)

In Vitro antipoliferative study of Compound 2a was performed by the National Cancer Institute (National Institutes of Health, Bethesda, Md., USA) against a panel of cancer cell lines in order to determine the concentrations needed to obtain a 50% inhibition of cell proliferation ($IC_{50}$). The operation of this unique screen utilizes 60 different human tumor cell lines, representing leukemia, melanoma, and cancers of the lung, colon, brain, ovary, breast prostate and kidney. Compound 2(a) was provided as a lyophilized powder with an estimated purity of 90+%. The compound was stored at −20° C. until day of use.

The human tumor cell lines of the cancer-screening panel were grown in RPMI 1640 medium containing 5% fetal bovine serum and 2 mM L-glutamine. For a typical screening experiment, cells were inoculated into 96 well microtiter plates in 100 µl at plating densities ranging from 5000 to 40,000 cells/well depending on the doubling time of individual cell lines (Table 8). After cell inoculation, the microtiter plates were incubated at 37° C., under 5% $CO_2$, 95% air and 100% relative humidity for 24 hours prior to addition of the experimental drugs.

After 24 hours, two plates of each cell line were fixed in situ with TCA, to represent a measurement of the cell population for each cell line at the time of drug addition (Tz). Compound 2(a) was solubilized in dimethyl sulfoxide at 400-fold the desired final maximum test concentration and stored frozen prior to use. At the time of drug addition, an aliquot of frozen concentrate was thawed and diluted to twice the desired final maximum test concentration with complete medium containing 50 µg/ml gentamicin. Additional four, serial dilutions were made to provide a total of five drug concentrations plus control. Aliquots of 100 µl of these different drug dilutions were added to the appropriate microtiter wells already containing 100 µl of medium, resulting in the required final drug concentrations ($2.5 \times 10^{-5}$ M to $2.5 \times 10^{-9}$ M).

Following drug addition, the plates were incubated for an additional 48 hours at 37° C., 5% $CO_2$, 95% air, and 100% relative humidity. For adherent cells, the assay was terminated by the addition of cold TCA. Cells were fixed in situ by the gentle addition of 50 µl of cold 50% (w/v) TCA (final concentration, 10% TCA) and incubation for 60 minutes at 4° C. The supernatant was discarded, and the plates were washed five times with tap water and air-dried. Sulforhodamine B (SRB) solution (100 µl) at 0.4% (w/v) in 1% acetic acid was added to each well, and plates were incubated for 10 minutes at room temperature. After staining, unbound dye was removed by washing five times with 1% acetic acid and the plates were air-dried. Bound stain was subsequently solubilized with 10 mM trizma base, and the absorbance was read on an automated plate reader at a wavelength of 515 nm. For suspension cells, the methodology was the same except that the assay was terminated by fixing settled cells at the bottom of the wells by gently adding 50 µl of 80% TCA (final concentration, 16% TCA).

The growth inhibitory power of compound 2(a) was measured by NCI utilizing the $GI_{50}$ value, rather than the classical $IC_{50}$ value. The $GI_{50}$ value emphasizes the correction for the cell count at time zero and, using the seven adsorbance measurements [time zero (Tz), control growth (C), and the test growth in the presence of drug at each of the five concentration levels (Ti)], $GI_{50}$ is calculated as $[(Ti-Tz)/(C-Tz) \times 100 = -50$. which is the drug concentration resulting in a 50% reduction in the net protein increase (as measured by SRB staining) in control cells during the drug incubation. The $GI_{50}$ values for compound 2(a) for the various cell lines tested are presented in Table 9 below.

TABLE 9

NCI Developmental Therapeutics Program In-Vitro Testing Results for Compound 2(a)

| Cell Line | Panel name | Inoculation density (no. of cells per well) | $GI_{50}$ ($\times 10^{-6}$, unless otherwise indicated) |
|---|---|---|---|
| K-562 | Leukemia | 5000 | 9.18 |
| MOLT-4 | Leukemia | 30,000 | 5.57 |
| A549/ATCC | Non-small cell lung cancer | 7500 | 4.09 |
| EKVX | Non-small cell lung cancer | 20,000 | 5.87 |
| HOP-62 | Non-small cell lung cancer | 10,000 | 6.83 |
| HOP-92 | Non-small cell lung cancer | 20,000 | $9.77 \times 10^{-8}$ |
| NCI-H226 | Non-small cell lung cancer | 20,000 | 3.10 |
| NCI-H23 | Non-small cell lung cancer | 20,000 | 4.25 |
| NCI-H322M | Non-small cell lung cancer | 20,000 | 3.48 |
| NCI-H460 | Non-small cell lung cancer | 7500 | 3.83 |
| NCI-H522 | Non-small cell lung cancer | 20,000 | 2.80 |
| COLO 205 | Colon cancer | 15,000 | 5.00 |
| HCC-2998 | Colon cancer | 15,000 | $6.03 \times 10^{-8}$ |
| HCT-116 | Colon cancer | 5000 | 4.18 |
| HCT-15 | Colon cancer | 10,000 | 3.25 |
| HT29 | Colon cancer | 5000 | 6.36 |
| KM12 | Colon cancer | 15,000 | 2.76 |
| SW-620 | Colon cancer | 10,000 | 5.35 |
| SF-268 | CNS cancer | 15,000 | 3.64 |
| SF-295 | CNS cancer | 10,000 | 3.91 |
| SNB-19 | CNS cancer | 15,000 | 5.58 |
| SNB-75 | CNS cancer | 20,000 | 3.87 |
| U251 | CNS cancer | 7500 | 3.65 |
| LOX IMVI | Melanoma | 7500 | 3.73 |
| MALME-3M | Melanoma | 20,000 | 2.40 |

TABLE 9-continued

NCI Developmental Therapeutics Program In-Vitro Testing Results for Compound 2(a)

| Cell Line | Panel name | Inoculation density (no. of cells per well) | $GI_{50}$ ($\times 10^{-6}$, unless otherwise indicated) |
|---|---|---|---|
| M14 | Melanoma | 15,000 | 4.15 |
| SK-MEL-2 | Melanoma | 20,000 | 4.34 |
| SK-MEL-28 | Melanoma | 10,000 | 6.75 |
| SK-MEL-5 | Melanoma | 10,000 | 4.16 |
| UACC-257 | Melanoma | 20,000 | 3.74 |
| UACC-62 | Melanoma | 10,000 | 2.68 |
| IGROV1 | Ovarian cancer | 10,000 | 2.95 |
| OVCAR-3 | Ovarian cancer | 10,000 | 3.40 |
| OVCAR-4 | Ovarian cancer | 15,000 | 4.48 |
| OVCAR-5 | Ovarian cancer | 20,000 | 4.00 |
| OVCAR-8 | Ovarian cancer | 10,000 | 4.34 |
| SK-OV-3 | Ovarian cancer | 20,000 | 7.94 |
| 786-0 | Renal cancer | 10,000 | 3.07 |
| A498 | Renal cancer | 25,000 | 4.82 |
| ACHN | Renal cancer | 10,000 | 2.96 |
| CAKI-1 | Renal cancer | 10,000 | 2.99 |
| RXF 393 | Renal cancer | 15,000 | 1.20 |
| SN12C | Renal cancer | 15,000 | $1.38 \times 10^{-7}$ |
| TK-10 | Renal cancer | 15,000 | 3.32 |
| UO-31 | Renal cancer | 15,000 | 3.65 |
| PC-3 | Prostate cancer | 7500 | 2.66 |
| DU-145 | Prostate cancer | 10,000 | 3.78 |
| MCF7 | Breast cancer | 10,000 | 4.22 |
| NCI/ADR-RES | Breast cancer | 15,000 | 4.76 |
| MDA-MB- | Breast cancer | 20,000 | 3.38 |
| MDA-MB-435 | Breast cancer | 15,000 | 3.26 |
| BT-549 | Breast cancer | 20,000 | 4.59 |
| T-47D | Breast cancer | 20,000 | 6.00 |

The results indicate that compound 2(a) is effective against all the human tumor cell lines that have been assayed in the NCl screening panel suggesting a broad anticancer activity against several types of human cancer. In fact, the $GI_{50}$ calculated for all cell lines was lower than $10 \times 10^{-6}$ M, a significant level of pharmacological activity for anticancer drugs, and in some cases reached the nanomolar or picomolar level (SN12C/renal carcinoma; HOP92/non-small cell lung carcinoma; HCC2998/colon carcinoma).

EXAMPLE 8

Activation of Inactive Domains in the Polyketide Synthase System

Figure 12A:
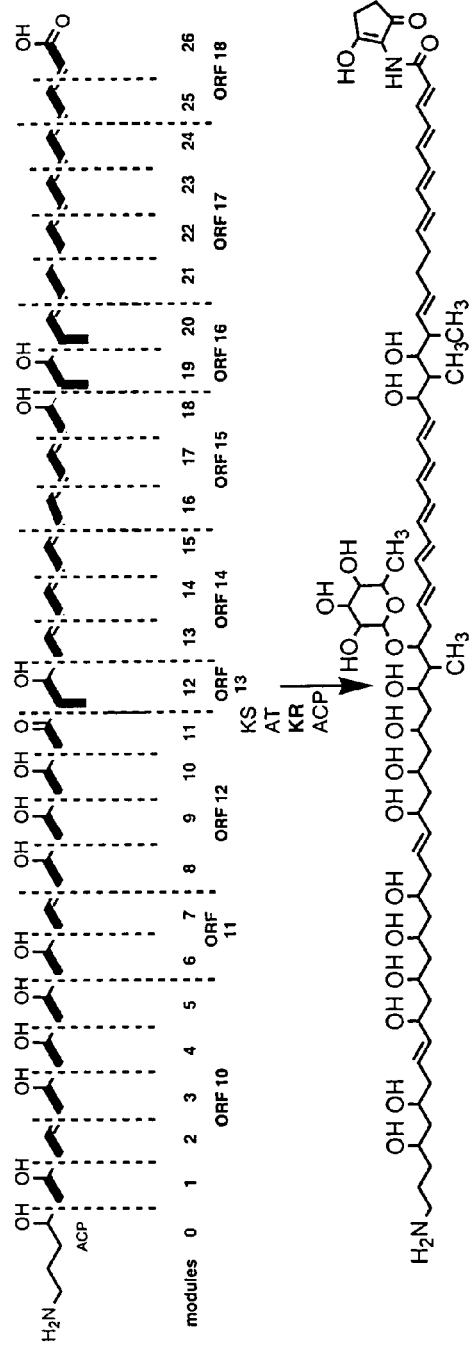

The gene cluster encoding the Compound 2(a) derived from *Streptomyces aizunensis* strain NRRL B-11277 is genetically modified to reactivate the ketoreductase (KR) domain, which is encoded in the ORF 13 module 12. This modification results in the conversion of the central carbonyl group adjacent to the sugar molecule of Compound 2(a), to a hydroxyl group (as shown in FIG. 12a).

In the compound 2(a) locus, the KR domain present in ORF 13, module 12 is inactive. To provide for the compound of Example 7 the KR domain is reactivated or swapped for an active KR domain. Reactivation of the KR domain requires diagnosis of the integrity of critical active site residues necessary for a functional KR domain. The active site residues can be divided into those required for co-enzyme activation of the KR enzyme and those for catalysis. Experiments identifying the specific residues for ketoreductase activity [Ried et. al. Biochemistry 2003, 42:72-79; Udo et. al, Biochemistry, 1997, 36:34-40] reveal that functional KR coenzyme binding site residues include glycine (G), glycine (G), glycine (G), alanine (A) and the functional KR active site residues include serine (S), tyrosine (Y) and asparagine (N). These residues are highlighted in FIGS. 6a and 6b. The sequence of the KR domain in the compound 2(a) locus shows that the coenzyme active site residues are glycine (G), glycine (G), glycine (G), alanine (A) indicating that this site is indeed active. However, the amino acid residues found in the KR site responsible for catalytic activity are serine (S), glutamine (Q) and asparagine (N) indicating that the catalytic site is likely to be inactive. This observation is confirmed by the fact compound 2(a) contains a carbonyl group at that specific position (FIG. 10, module 12). Modification of the codon encoding glutamine to a codon encoding tyrosine provides for an active site residue required for functional ketoreduction of PKS monomers. This results in an altered nucleic acid sequence of the compound 2(a) locus used to modify a suitable host cell to produce the compound 2(a) variant of Example 7 as shown in FIG. 12a.

The modification of glutamine to tyrosine may be introduced using a mismatched primer that hybridizes to the native nucleotide sequence at a temperature below the melting temperature of the mismatched duplex. The primer is kept specific by keeping primer length and base composition within narrow limits and keeping the mutant base centrally located as described in Zoller and Smith' Methods in Enzymol. (1983) 100:468. Primer extension is achieved

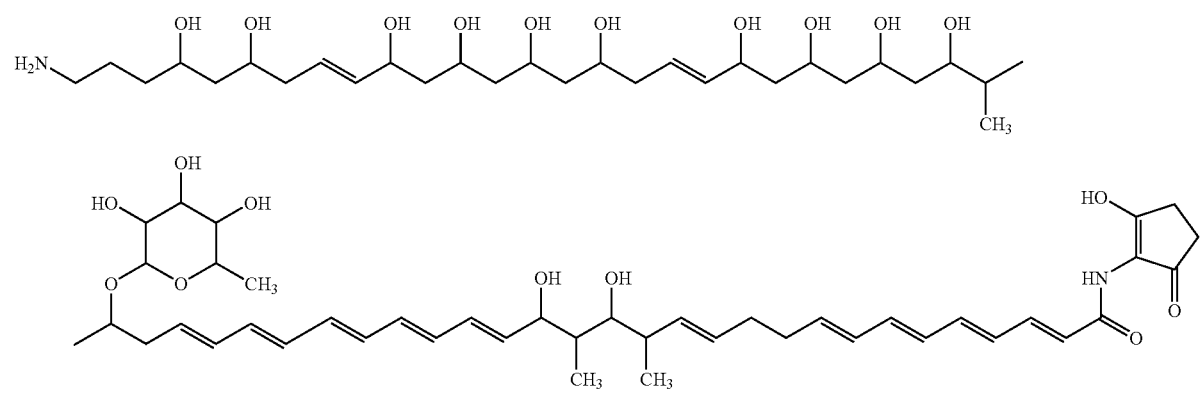

using DNA polymerase. The product is cloned and positive clones containing the mutated DNA, derived by segregation of the primer extended strand, are selected. Selection is made using the mutant primer as a hybridization probe (Dalbie-McFarland et al Proc. Natl. Acad Sci. USA (1982) 79:6409).

supra. After selection recombinant strains are produced with the domain of interest replacing the original domain.

EXAMPLE 9

Inactivation of Functional Domains within the Polyketide Synthase System

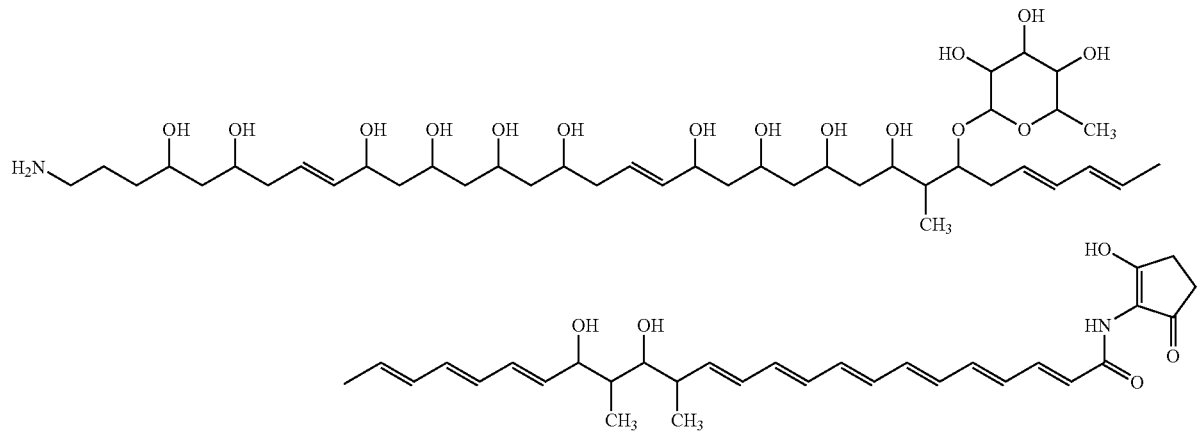

Another method to generate the compound of Example 7 involves swapping the inactive ketoreductase domain from the gene locus of the compound 2(a) (ORF 13 module 12) with an active ketoreductase domain from the same or different locus. Example of domains within the same locus suitable for swapping include the active ketoreductases that occur in the modules that encode the incorporation of methyl malonate extender units, namely ORF 16 modules 19 or 20. Swapping of acyltransferase domains between PKS loci has been demonstrated by Oliynyk et.al. Chem Biol, 1996, 3(10):833-9, wherein the gene encoding the acyltransferase domain in 6-deoxyerythronolide (DEBS) module 1 is swapped with the gene encoding the rapamycin module 2 acyltransferase resulting in the synthesis of novel triketides since the two acyltransferases had different acyl specificities. In Hans et.al J Am Chem Soc, 2003, 125(18): 5366-74, the kinetic aspects of product formation as a consequence of acyltransferase domain swaps is taught.

Swapping of domains is achieved using techniques developed by Kao et.al. Science, 1994, 265:509-512. The genetic strategy utilizes derivatives of pMAK705 to permit in vivo recombination between a temperature sensitive donor plasmid and a recipient shuttle vector by means of a double recombination event in E. coli. An $Amp^R$ $Tc^R$ recipient subclone of the regions flanking the domain to be swapped is made, pCK5, containing 1 kb of flanking sequence from either flank. Endonuclease restriction sites are introduced at the boundaries of the domain, PstI at 3' end of the left flank and XbaI at the 5' end of the right flank. Subclones pCK6 $Cm^R$ of the domains to be swapped are generated and endonuclease restriction sites are introduced into the boundaries of the domain. The restriction site PstI is introduced at the 5' boundary of the KR domain and an XbaI site at the 3' boundary of the domain. Restriction sites are introduced into subclones by PCR mutagenesis. The fragment containing the domain is excised and ligated into the temperature sensitive $Cm^R$ donor plasmid, pCK6. The recipient plasmid is generated by in vivo recombination of the plasmid in the host strain using the selection method outlined by Kao et.al., The gene locus encoding Compound 2(a) derived from a Streptomyces aizunensis strain is genetically modified to inactivate the enoyl reductase (ER) domain in the ORF 17 module 22. Inactivation of this domain abolishes the conversion the double bond to the single bond between the acyl units incorporated by modules 21 and 22 of Compound 2(a) (as shown in FIG. 12e).

Generating the compound of Example 8 is achieved through insertional inactivation by double crossover techniques developed by Oh and Chater, 1997, Journal of Bacteriology 179:122-127. Examples of insertional inactivation of genes involved in polyketide biosynthesis in Streptomyces are well known in the art. Arrowsmith et.al., 1992, Mol Gen Genet 234:254-264, used these techniques to identify the role of a cassette of secondary metabolic genes in the production of monensin by Streptomyces cinnamonensis. Paradkar, et.al., 2001, Appl Environ Microbiol 67:2292-7, inactivated the lat gene encoding for lysine aminotransferase to disrupt the first step in the cephamycin pathway to block production of cephamycin C in Streptomyces clavuligerus. Similarly, these authors inactivated the cvm1 gene involved in late stage antipodal clavam synthesis.

Methods used to inactivate domains in polyketide systems include domain swapping as described in Example 7 as well as targeted disruption by insertional gene inactivation. For this, a replicative plasmid-mediated homologous recombination is applied to Streptomyces aizunensis. Plasmids for homologous recombination are constructed by cloning a kanamycin resistance marker between the left and right flanking regions of the genes to be modified. Such a construct is cloned into a delivery plasmid that is marked with thiostrepton resistance producing a disruption plasmid. This plasmid is introduced into Streptomyces aizunensis by either PEG-mediated protoplast transformation, by electroporation or by natural infection with a phage (Keiser et al (2000) Practical Streptomyces genetics, John Innes Foundation, Norwich). The spores from individual transformants or transconjugants are cultured on non-selective plates to induce recombination. The cycle is repeated three times to enhance the opportunity for recombination. Crossovers yielding targeted gene recombinants are then selected and screened using kanamycin and thiostrepton for single crossovers and kanamycin for double crossovers. Replica plating and southern hybridization are used to confirm the double crossover inactivation (Keiser et al (2000) supra.).

EXAMPLE 10

Inactivation of the Glycosyltransferase Activity

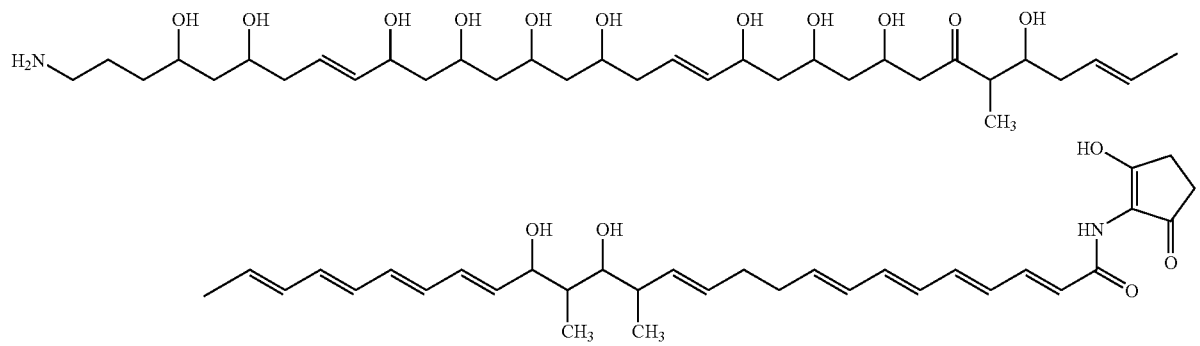

Figure 12B:
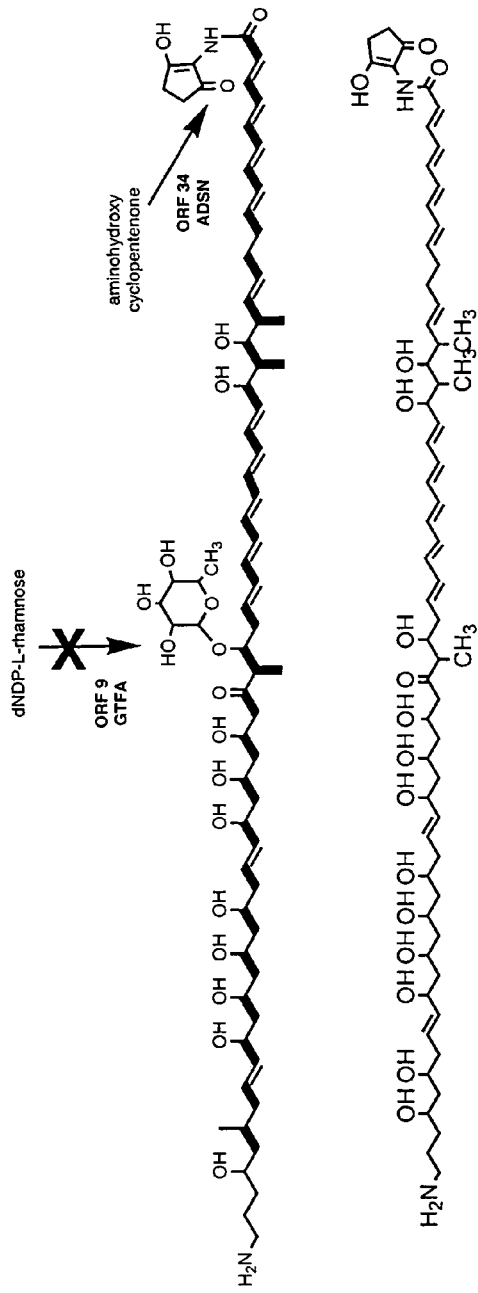

Inactivation of the glycosyltransferase gene (GTFA) encoding ORF 9 of the compound 2(a) locus (as shown in FIG. 12b) provides for the compound of this example. The inactivation of the GFTA disrupts the transfer of the sugar moiety onto the backbone of Compound 2(a). The absence of the sugar moiety results in a non-glycosylated form of Compound 2(a). Insertional inactivation of GTFA genes in polyketide biosynthesis in *Streptomyces* is known in the art. Blanco et.al., 2000, Mol Gen Genet 262:991-1000, identified two genes of the mithramycin biosynthetic gene cluster as glycosyltransferases by the production of a non-glycosylated mithramycin upon inactivation of these genes. A similar observation was made by Chen et.al, Gene, 2001, 263: 255-64 investigating genes responsible for glycosylation in the biosynthetic pathways encoding pikromycin, narbomycin, methymycin and neomethymycin.

Targeted inactivation of the glycosyltransferase activity is achieved using the method of insertional gene disruption as described in Example 8.

EXAMPLE 11

Elimination of the Aminohydroxycyclopent n n Unit

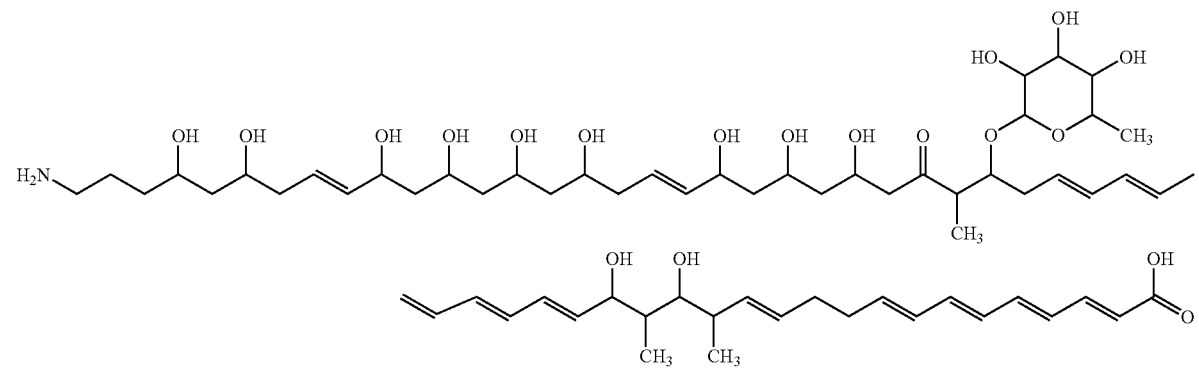

Figure 12C:
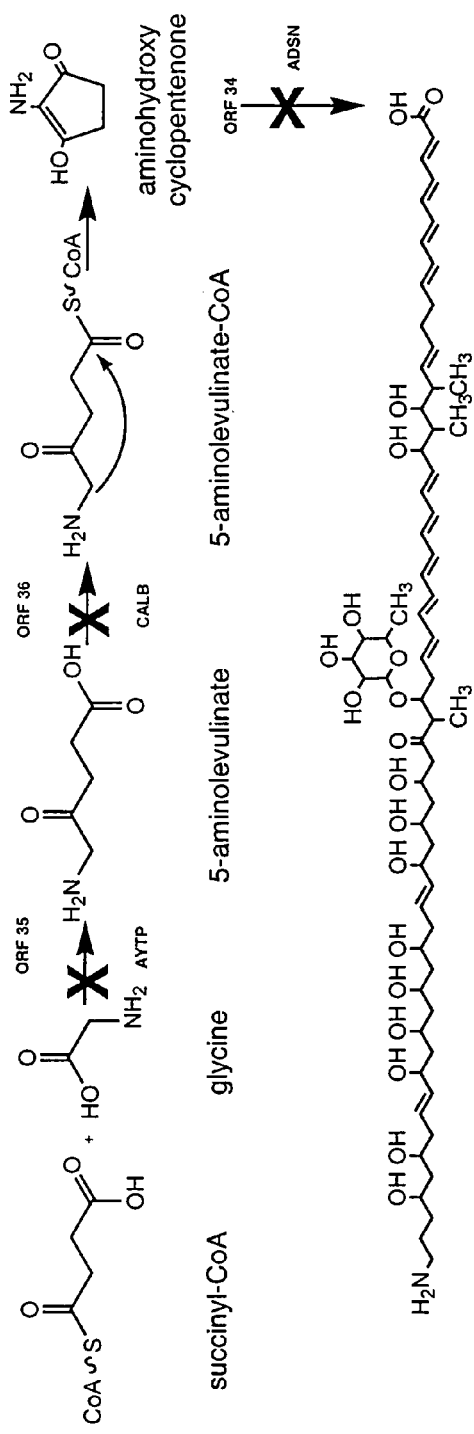

Elimination of the terminal aminohydroxycyclopentenone unit may be accomplished by inactivation of any one of the following three ORFs of the compound 2(a) locus. First, disruption of ORF 35 results in the inactivation of the acyltransferase (AYTP) activity (as shown in FIG. 12c) that abolishes condensation of succinyl-CoA and glycine to form 5-aminolevulinate. Second, disruption of ORF 36 results in the inactivation of acyl CoA ligase (CALB) preventing the conversion of 5-aminolevulinate to 5-aminolevulinate-CoA which cyclizes to form aminohydroxycyclopentenone. Third, disruption of ORF 34 (ADSN) prevents transfer of the aminohydroxycyclopentenone unit to the polyketide chain. Thus, the compound of Example 10 is provided by genetically modifying at least one of ORFs 34, 35 and 36. Methods used for insertional inactivation of all three genes are described in Example 9.

EXAMPLE 12

Replacement of the Terminal Amine Group with a Guanidino Group

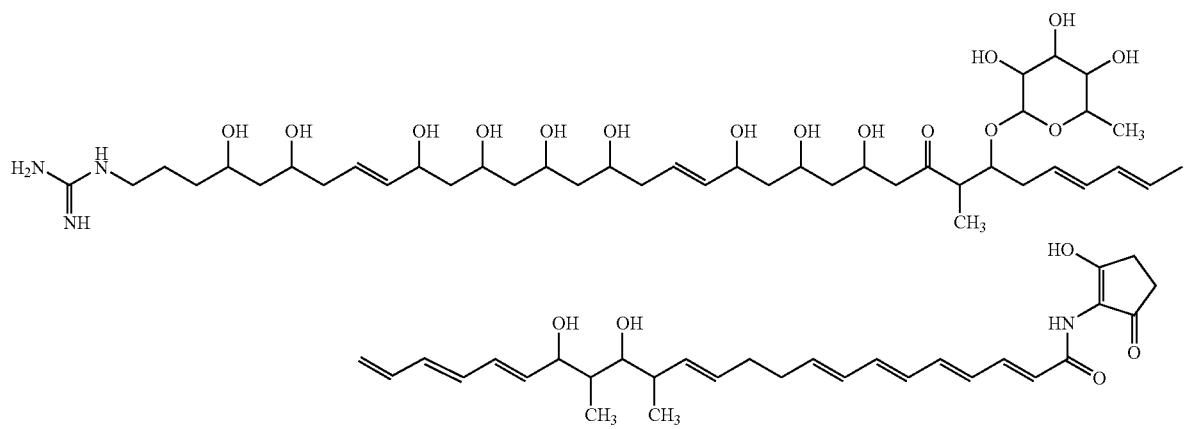

Figure 12D:
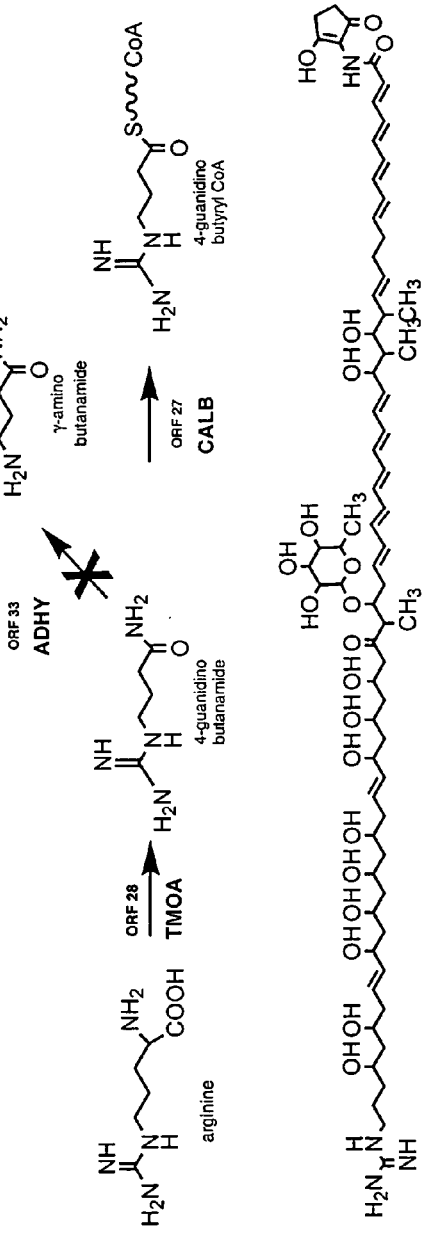
Figure 12E:
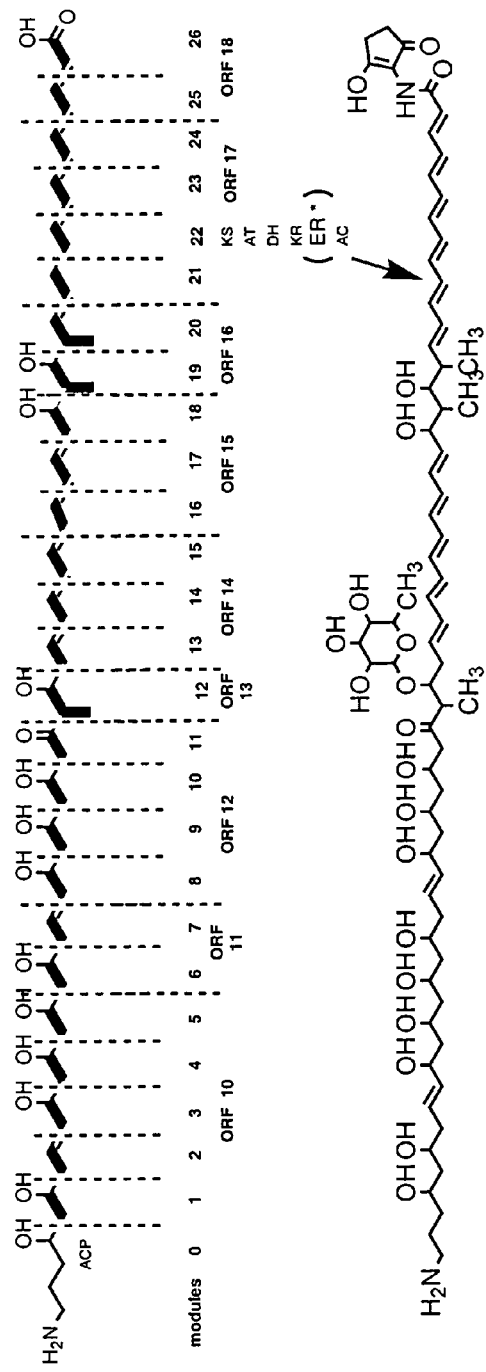
Figure 12F:
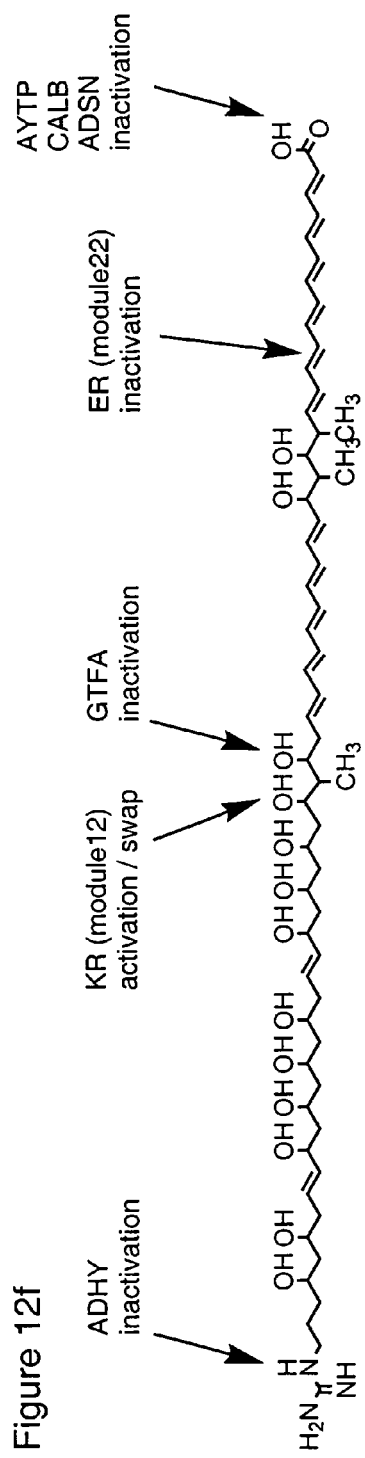

The replacement of the terminal amine with a guanidino group may be accomplished by the insertional inactivation of ORF 33 (ADHY) using the methods described in Example 9. The inactivation of ORF 33 ADHY (as shown in FIG. 12d) disrupts the synthesis of gamma-amino butanamide leading to the accumulation of 4-guanidino butanamide. The accumulated 4-guanidino butanamide is converted by ORF 27 CALB to 4-guanidino butyryl-CoA which is then attached onto the polyketide synthase enzyme (ORF 10, module 0 as shown in FIG. 10b) through the action of ORF 19 (AYTF).

EXAMPLE 13

Synthesis of Compound 2(b) by Epoxidation of Compound 2(a)

To a mixture of Compound 2(a) dissolved in tetrahydrofuran (THF) is added 1 equivalent of meta-chloroperbenzoic acid. The reaction is cooled in an ice bath and stirred at 0° C. for 1-2 hours. The reaction mixture is then evaporated to dryness, re-dissolved in methanol and subjected to liquid chromatography on a column of Sephadex LH-20 to isolate the Compound 2(b).

The epoxide group of Compound 2(b) may be hydrolyzed by treatment of Compound 2(b) with small quantity of aqueous hydrochloric acid (1.0 N), thereby forming the corresponding diol of the formula:

Compound 2(b)

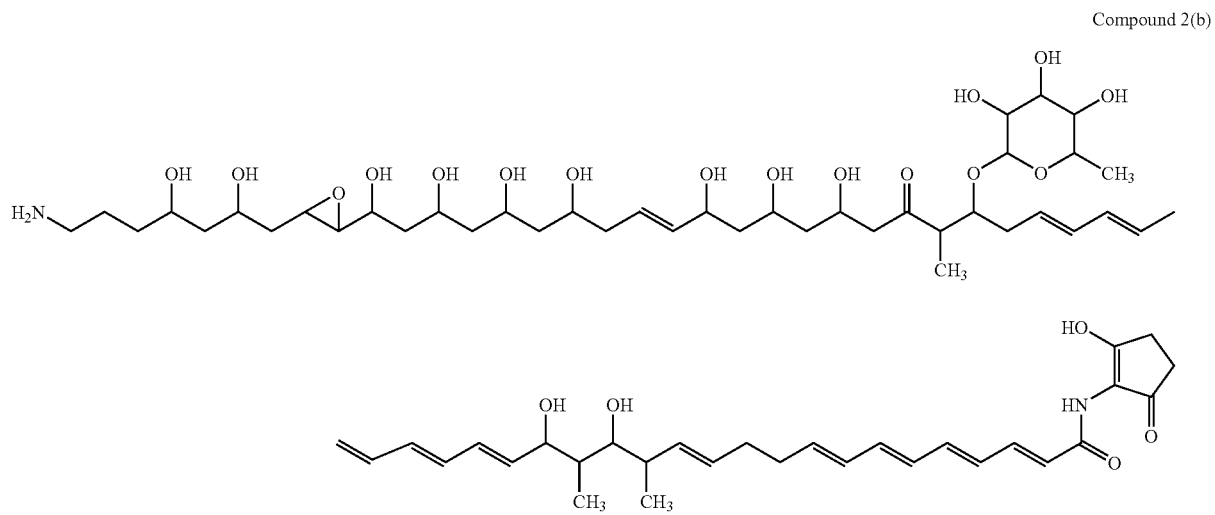

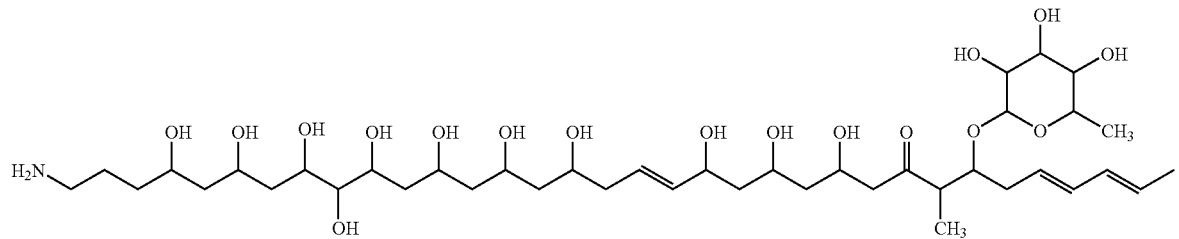

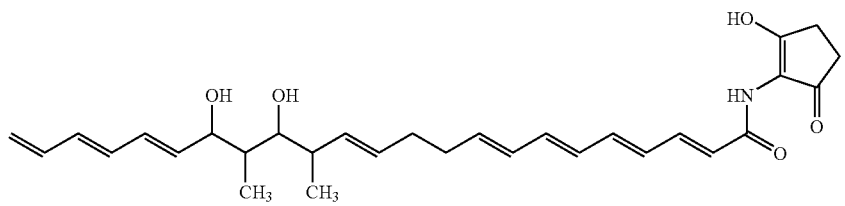

EXAMPLE 14

Synthesis of Compound 2(c) by Reduction of 31-oxo Group

Compound 2(c)

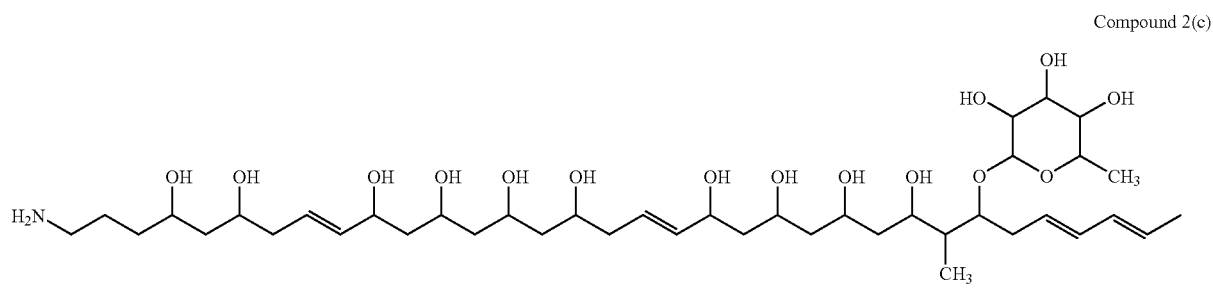

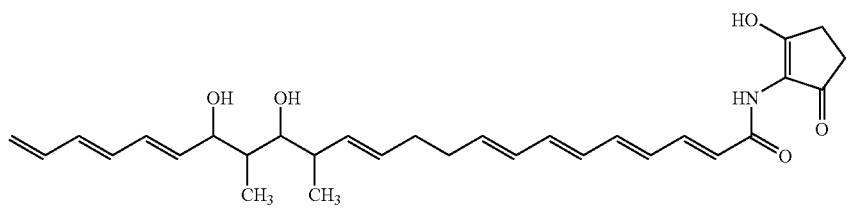

A solution of Compound 2(a) in acetonitrile is treated with 1.5 equivalents of NaCNBH$_3$. The reaction is stirred at room temperature for 1 hour. The reaction mixture is then concentrated to dryness and then taken up into methanol. The mixture is filtered and the filtrate is subjected to liquid chromatography on a column of Sephadex LH-20 to isolate the Compound 2(c). Alternatively, the reduction of the oxo group at the 31-position may be done using lithium borohydride (LiBH$_4$).

EXAMPLE 15

Synthesis of Compound 2(d) by Addition of Acetal Ring at the 31-position

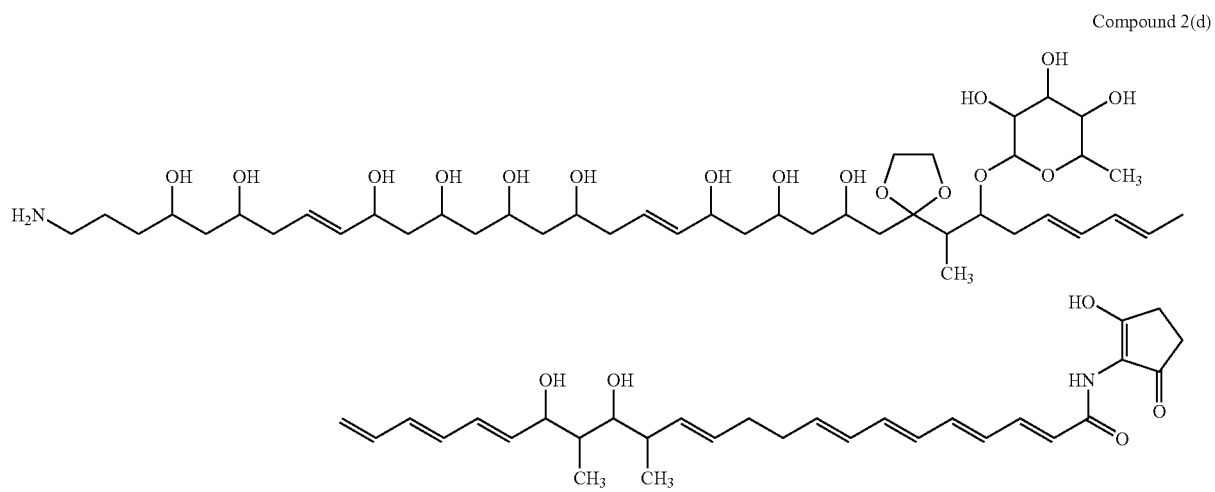

Compound 2(d)

A solution of Compound 2(a) in tetrahydrofuran is treated with 3 equivalents of 2,2-dimethyl-1,3-dioxacyclopentane in the presence of a trace amount of toluene sulfonic acid. The reaction is stirred overnight at room temperature, evaporated to dryness and taken up into dry THF, followed by purification by liquid chromatography on a column of Sephadex LH-20. The 2,2-dimethyl-1,3-dioxacyclopentane may be synthesized by reaction of acetone with ethylene glycol in the presence of a trace of toluene sulfonic acid, over molecular sieves to remove water.

Alternatively, the addition of an acetal ring at the 31-position may be accomplished by reaction of Compound 2(a) with an excess of ethylene glycol in the presence of a trace of toluene sulfonic acid. The reaction may be conducted over molecular sieves to remove water.

EXAMPLE 16

Synthesis of Compound 2(e)

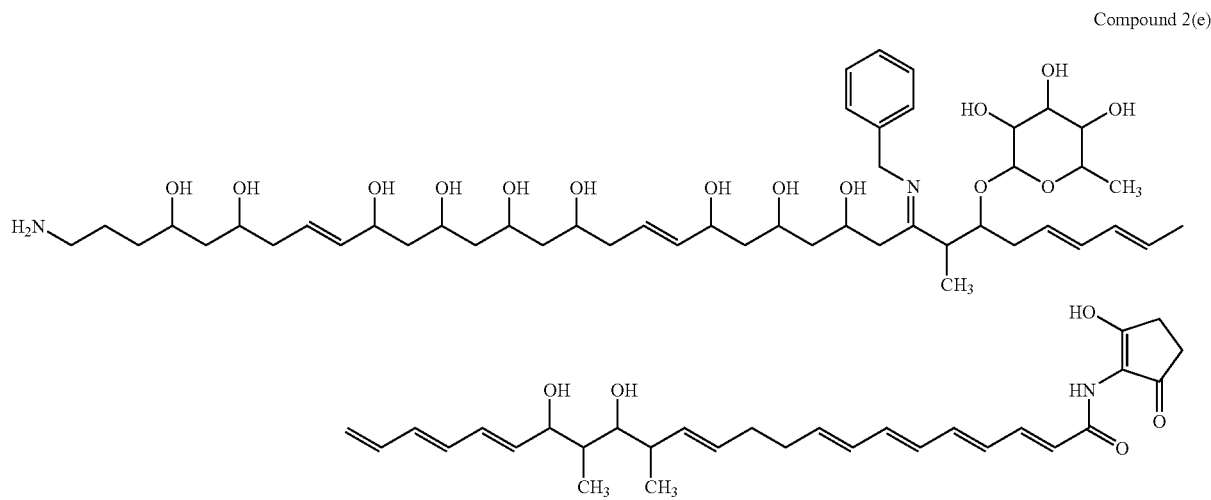

Compound 2(e)

To a solution of Compound 2(a) in benzene or toluene is added 10 equivalents of benzylamine. The reaction is stirred at room temperature overnight. The reaction may be conducted over molecular sieves to remove water; alternatively, the water may be removed under reflux as an azeotrope with benzene or toluene using a Dean-Stark trap. The reaction mixture is concentrated under vacuum and residual reagent is removed by high vacuum at room temperature overnight.

The carbon-nitrogen double bond of Compound 2(e) may be reduced to the amine by reaction of Compound 2(e) with NaCNBH$_3$ or LiBH$_4$ (1.5 equivalents) in acetonitrile, to form a compound of the structure:

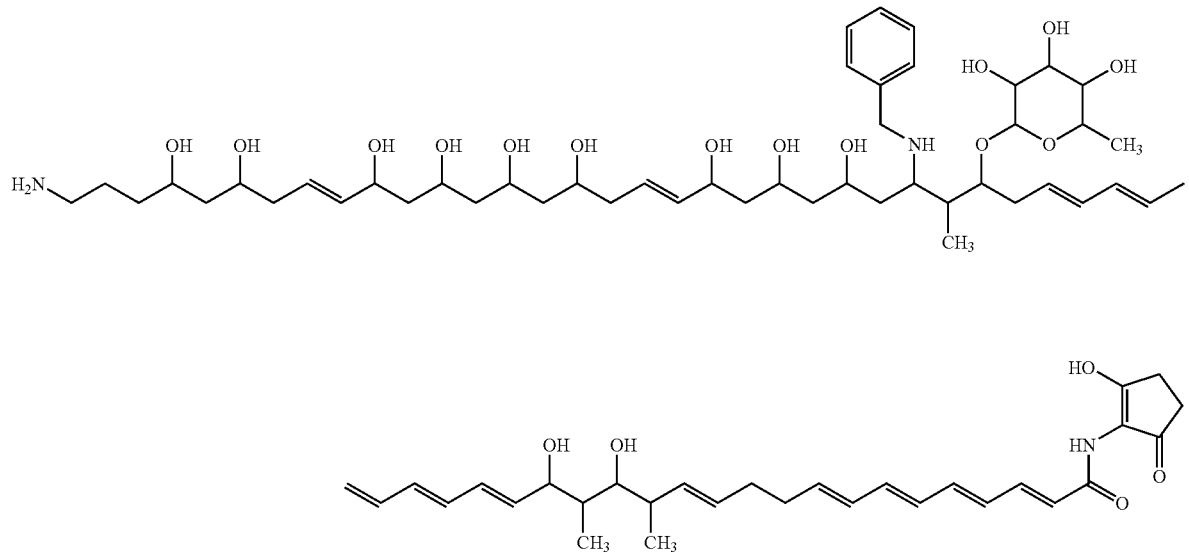

EXAMPLE 17

Synthesis of Compound 2(f)

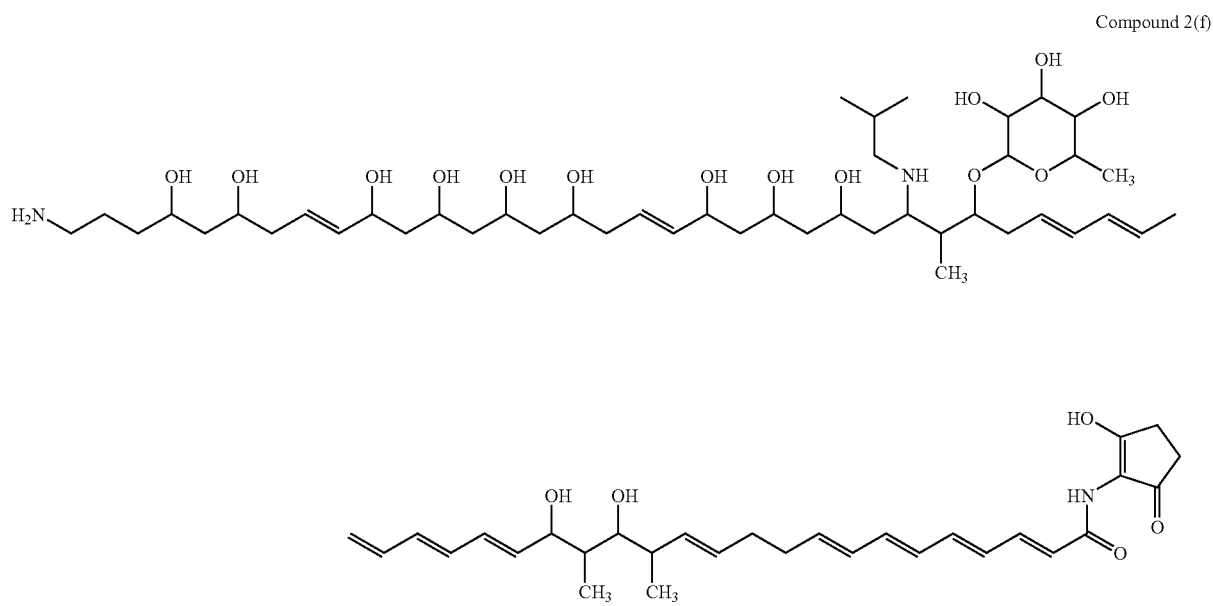

To a solution of one equivalent of Compound 2(a) in acetonitrile is added ten equivalents of isobutylamine. The reaction is stirred at room temperature for two hours. Benzene (¹/₁₀ volume) is added and the mixture is concentrated to dryness under vacuum on a rotary evaporator.

The Schiff base is then treated with NaCNBH$_3$ or LiBH$_4$ (1.5 equivalents) in acetonitrile, to reduce the carbon-nitrogen double bond of the imine to the amine, to form the compound 2(f).

EXAMPLE 18

Synthesis of Compound 2(g)

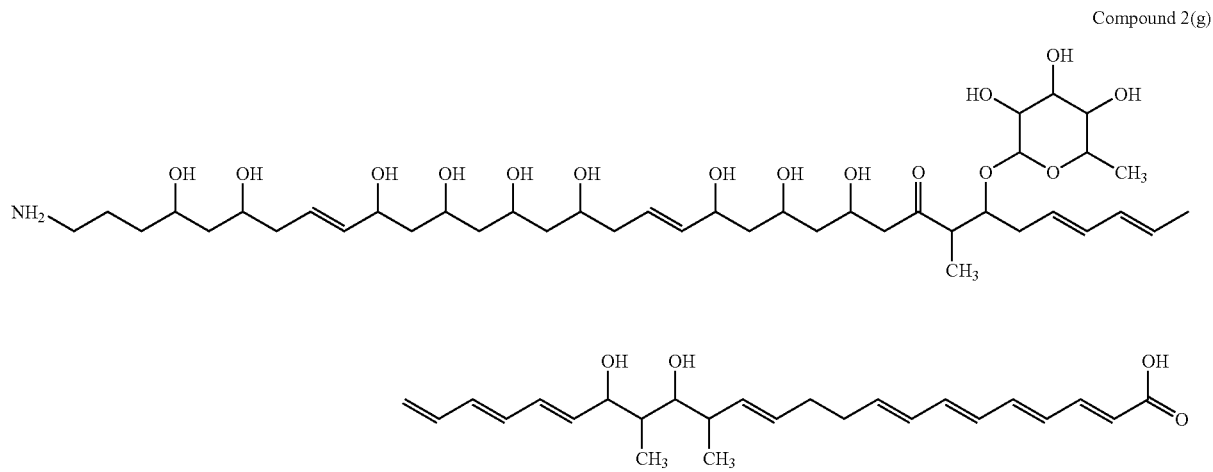

Compound 2(g) may be synthesized biosynthetically as described in Example 9. Alternatively, Compound 2(g) may be prepared by hydrolysis of Compound 2(a). This is accomplished by treatment of Compound 2(a) in diethylether/THF with Meerwein's reagent (triethyloxonium tetrafluoroborate) for two hours at room temperature followed by cooling to −20° C. and dropwise addition of aqueous acetic acid in THF. The reaction mixture is stirred for 20 minutes during which time it is allowed to come to room temperature. The mixture is then diluted with water (2 volumes) and HP-20 polystyrene resin is added. The mixture is stirred for 30 minutes, filtered, the resin is washed well with water, and the product is eluted with 100% ethanol. The elutes are concentrated under vacuum to give compound 2(g).

EXAMPLE 19

Synthesis of Compound 2(h)

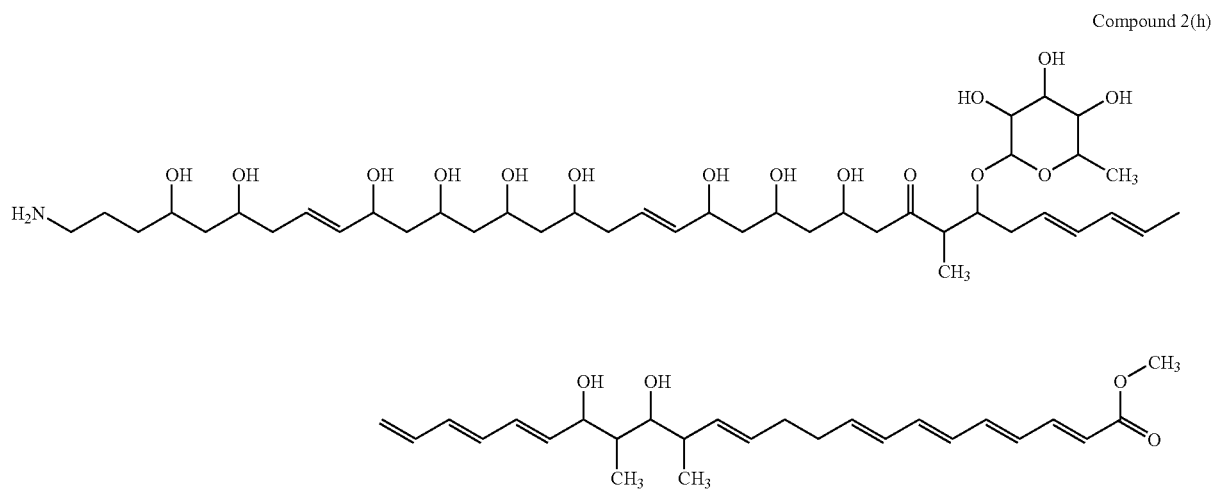

To a solution of 0.1 equivalents of Compound 2(g) in methanol is added 0.5 equivalents of diazomethane in diethyl ether. The reaction mixture is allowed to stand at room temperature overnight, and then the solvent is removed under vacuum to give compound 2(h).

EXAMPLE 20

Synthesis of Compound 2(i)

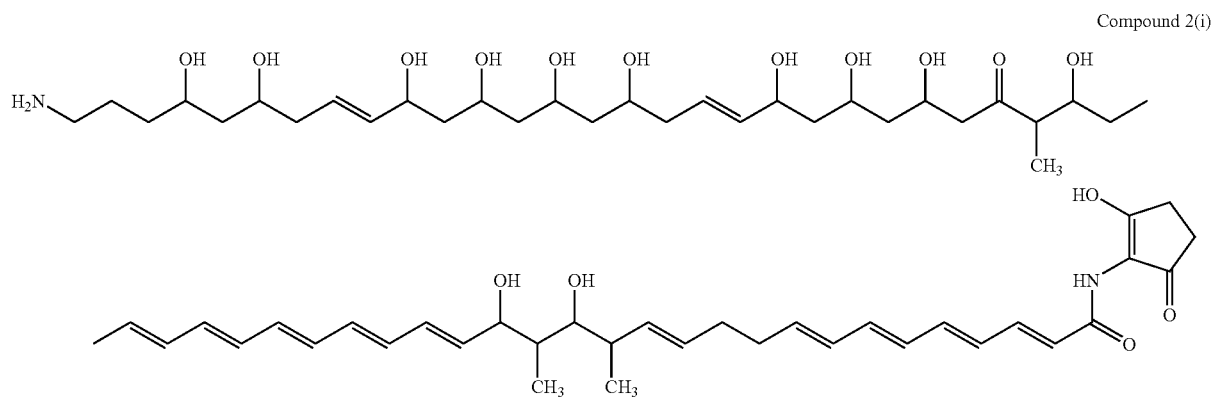

Compound 2(i)

A solution of Compound 2(a) in methanol is treated with an equal volume of 0.1 N HCl, and the reaction mixture is stirred overnight at room temperature. The mixture is then diluted with water (2 volumes) and HP-20 polystyrene resin is added. The mixture is stirred for 30 minutes, filtered, the resin is washed well with water, and the product is eluted with 100% ethanol. The elutes are concentrated under vacuum to give compound 2(i).

EXAMPLE 21

Synthesis of Compound 2(j)

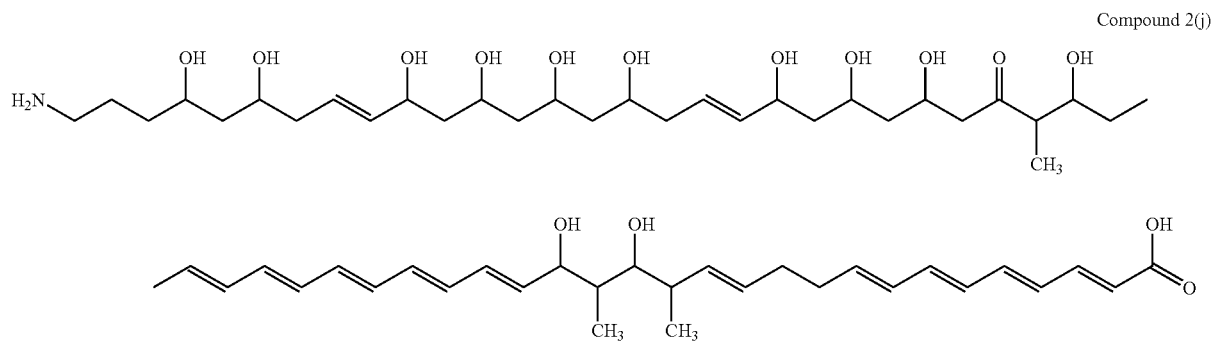

Compound 2(j)

Compound 2(j) is prepared by hydrolysis of compound 2(g). The hydrolysis may carried out in the same way that compound 2(a) is hydrolysed to compound 2(i) as described in Example 19 above.

EXAMPLE 22

Synthesis of Compound 2(k)

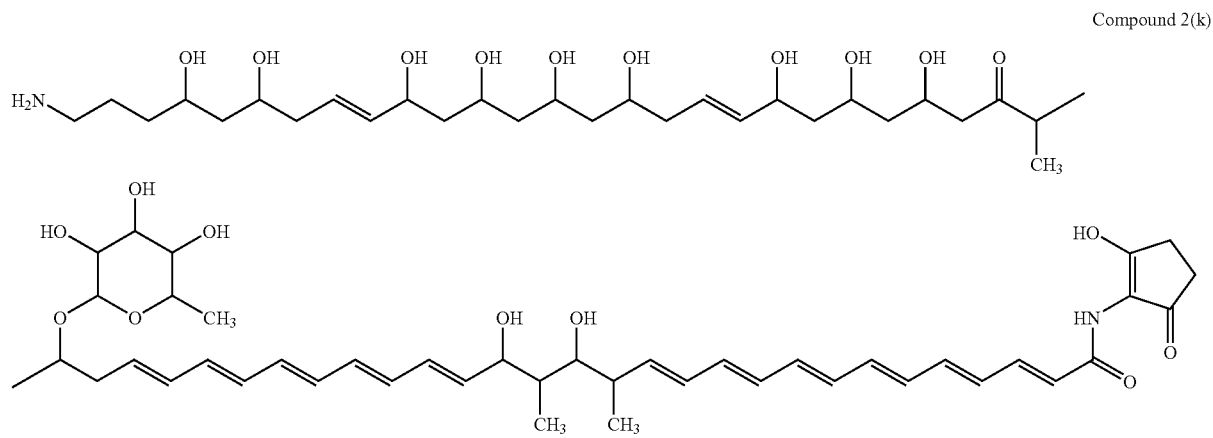

Compound 2(k)

Compound 2(k) is prepared biosynthetically by inactivation of the enoyl reductase as described in Example 8.

EXAMPLE 23

Synthesis of Compound 2(l)

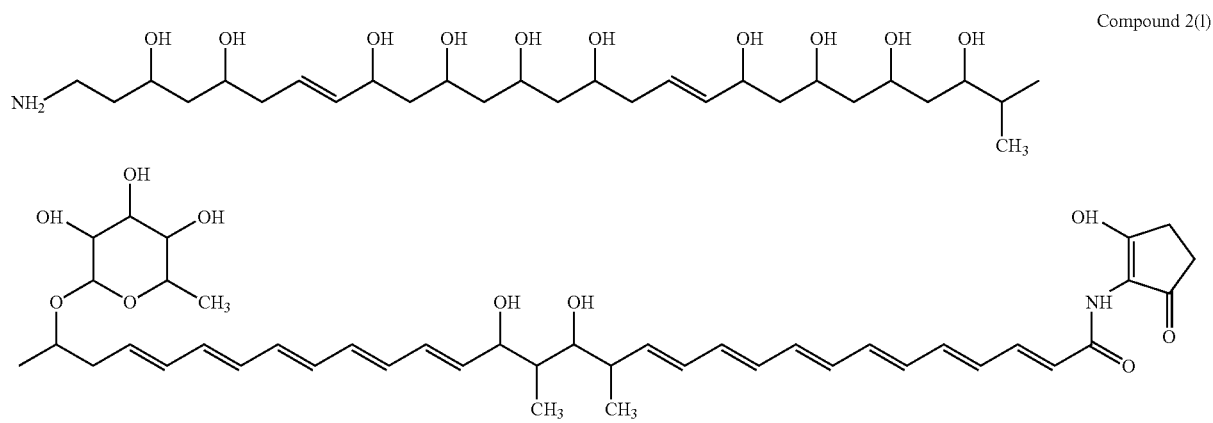

Compound 2(l)

A solution of Compound 2(k) in acetonitrile is treated with 1.5 equivalents of $NaCNBH_3$. The reaction is stirred at room temperature for 1 hour. The reaction mixture is then concentrated to dryness and then taken up into methanol. The mixture is filtered and the filtrate is subjected to liquid chromatography on a column of Sephadex LH-20 to isolate the Compound 2(l). Alternatively, the reduction of the oxo group at the 31-position may be done using lithium borohydride ($LiBH_4$).

EXAMPLE 24

Synthesis of Compound 2(m)

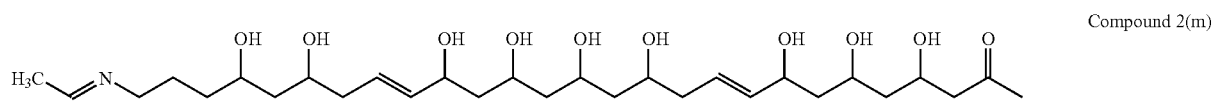

Compound 2(m)

-continued

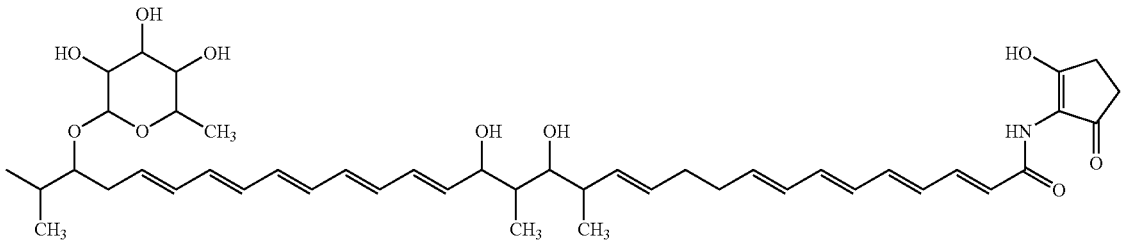

A solution of 10 equivalents of Compound 2(a) in acetonitrile is treated with one equivalent of acetaldehyde. The reaction is stirred at room temperature for two hours. Benzene (1/10 volume) is added and the mixture is concentrated to dryness under vacuum on a rotary evaporator to give the compound 2(m).

Compound 2(m) may be treated with NaCNBH$_3$ or LiBH$_4$ (1.5 equivalents) in acetonitrile, to reduce the carbon-nitrogen double bond of the imine to the amine.

EXAMPLE 25

Synthesis of Compound 2(n)

zene (1/10 volume) is added and the mixture is concentrated to dryness under vacuum on a rotary evaporator to give the compound 2(n).

Compound 2(n) may be treated with NaCNBH$_3$ or LiBH$_4$ (1.5 equivalents) in acetonitrile, to reduce the carbon-nitrogen double bond of the imine to the amine.

EXAMPLE 26

Synthesis of Compound 2(o)

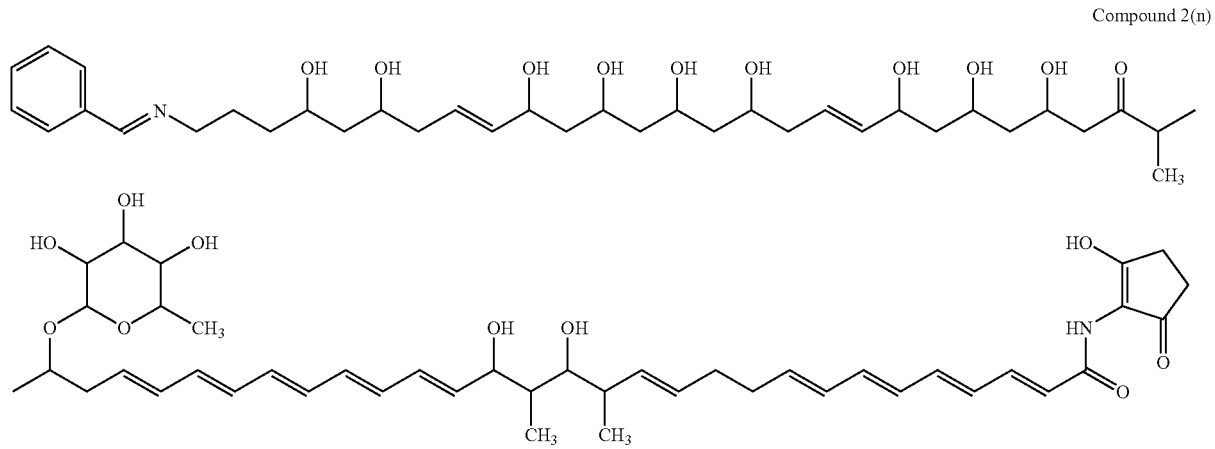

A solution of 10 equivalents of Compound 2(a) in acetonitrile is treated with one equivalent of benzaldehyde. The reaction is stirred at room temperature for two hours. Ben-

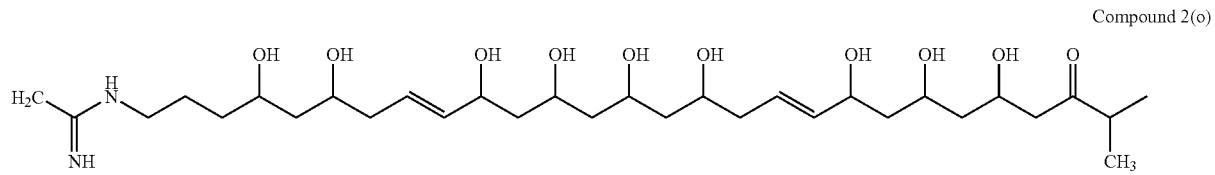

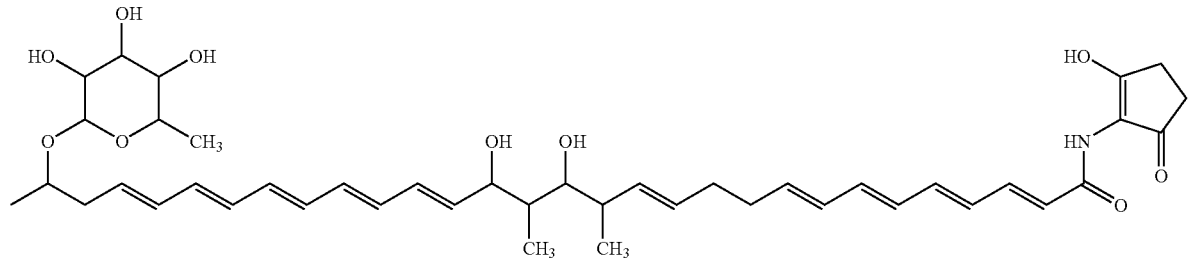

A solution of Compound 2(a) in tetrahydrofuran is treated with one equivalent of cyanamide. The reaction mixture is stirred at room temperature overnight. Solvent is removed from the reaction mixture under vacuum to give compound 2(o).

EXAMPLE 27

Synthesis of Compound 2(p)

To a solution of 10 equivalents of Compound 2(a) in acetonitrile is added 1 equivalent of acetone. The reaction is stirred at room temperature for two hours. Benzene (1/10 volume) is added and the mixture is concentrated to dryness under vacuum on a rotary evaporator.

The resulting Schiff base imine is then treated with NaCNBH$_3$ or LiBH$_4$ (1.5 equivalents) in acetonitrile, to reduce the carbon-nitrogen double bond of the imine to the amine, to form the compound 2(p).

Compound 2(p)

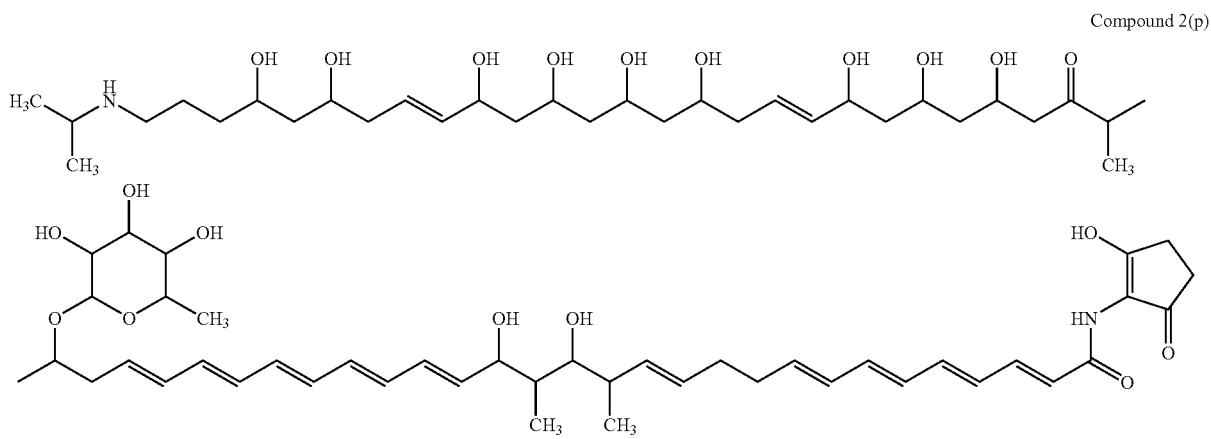

EXAMPLE 28

Synthesis of Compound 2(q)

Compound 2(q)

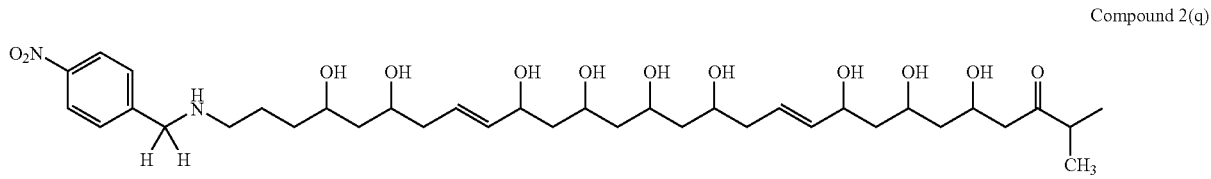

-continued

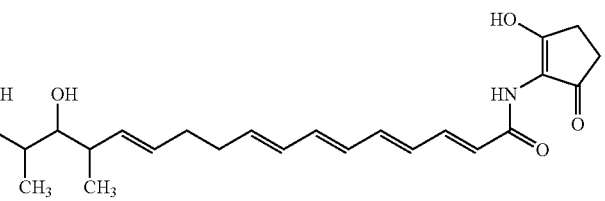

To a solution of 10 equivalents of Compound 2(a) in acetonitrile is added 1 equivalent of 4-nitrobenzaldehyde. The reaction is stirred at room temperature for two hours. Benzene (1/10 volume) is added and the mixture is concentrated to dryness under vacuum on a rotary evaporator.

The resulting Schiff base imine is then treated with NaCNBH$_3$ or LiBH$_4$ (1.5 equivalents) in acetonitrile, to reduce the carbon-nitrogen double bond of the imine to the amine, to form the compound 2(q).

EXAMPLE 29

Synthesis of Compound 2(r)

To a solution of 10 equivalents of Compound 2(a) in acetonitrile is added 1 equivalent of cyclohexylformaldehyde. The reaction is stirred at room temperature for two hours. Benzene (1/10 volume) is added and the mixture is concentrated to dryness under vacuum on a rotary evaporator.

The resulting Schiff base imine is then treated with NaCNBH$_3$ or LiBH$_4$ (1.5 equivalents) in acetonitrile, to reduce the carbon-nitrogen double bond of the imine to the amine, to form the compound 2(r).

Compound 2(r)

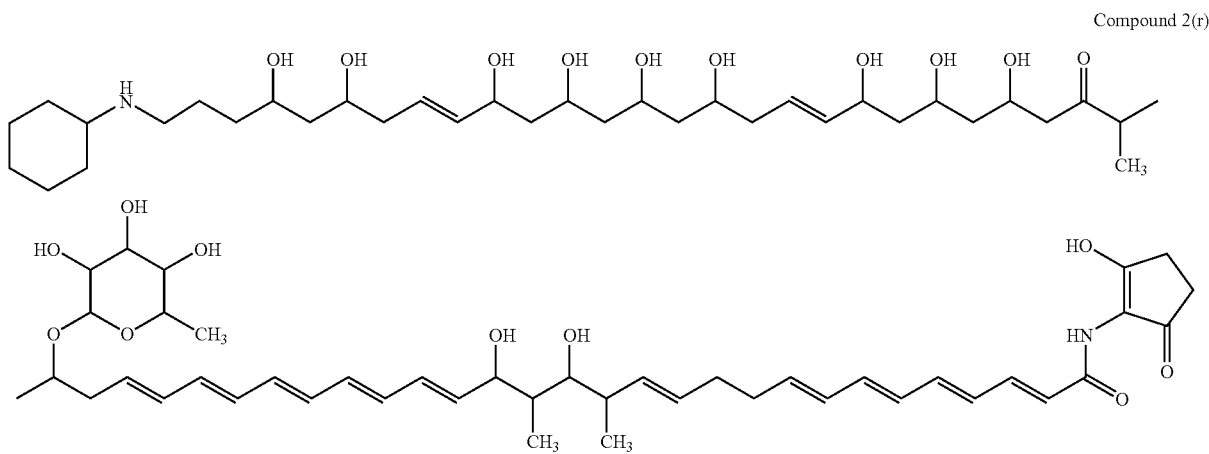

EXAMPLE 30

Synthesis of Compound 2(s)

Compound 2(s)

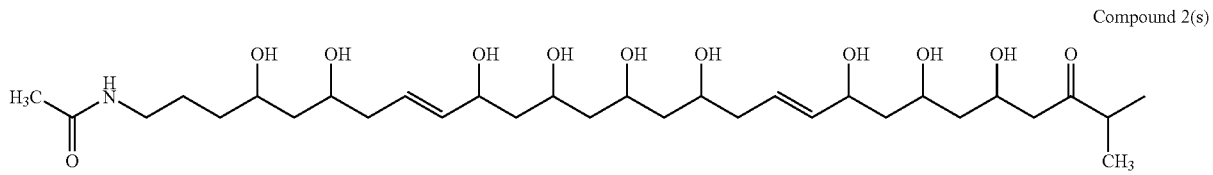

-continued

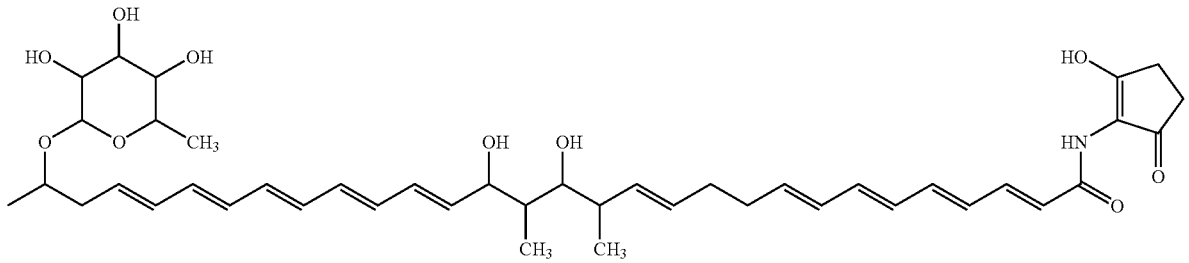

To a solution of Compound 2(a) in tetrahydrofuan is added one equivalent of acetic anhydride and two equivalents of triethylamine. The reaction is stirred at room temperature for two hours. The mixture is then diluted with water (2 volumes) and HP-20 polystyrene resin is added. The mixture is stirred for 30 minutes, filtered, the resin is washed well with water, and the product is eluted with 100% ethanol. The elutes are.concentrated under vacuum to give compound 2(s).

EXAMPLE 31

Synthesis of Compound 2(t)

To a solution of Compound 2(a) in is added one equivalent of isobutyrl anhydride and two equivalents of triethylamine. The reaction is stirred at room temperature for two hours. The mixture is then diluted with water (2 volumes) and HP-20 polystyrene resin is added. The mixture is stirred for 30 minutes, filtered, the resin is washed well with water, and the product is eluted with 100% ethanol. The elutes are concentrated under vacuum to give compound 2(t).

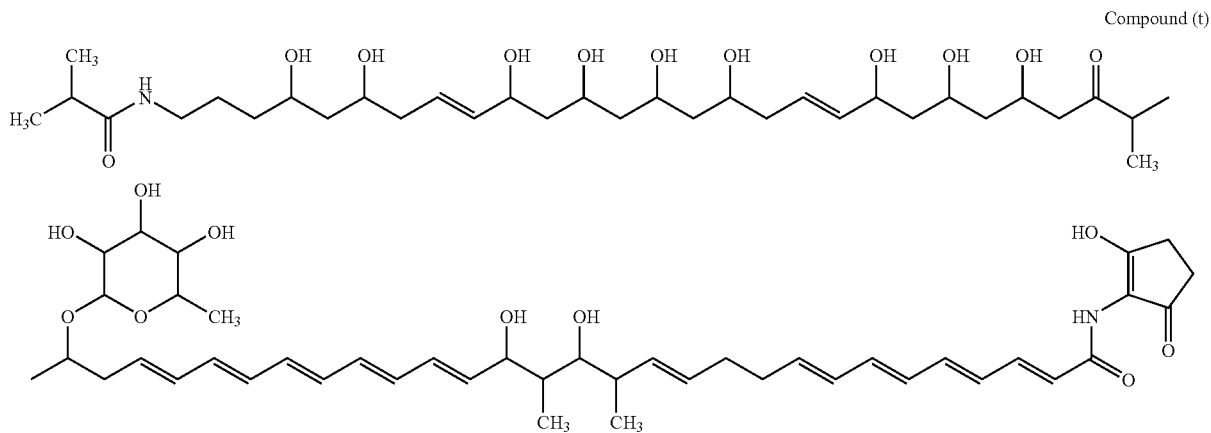

Compound (t)

Compound 2(u)

EXAMPLE 32

Synthesis of Compound 2(u)

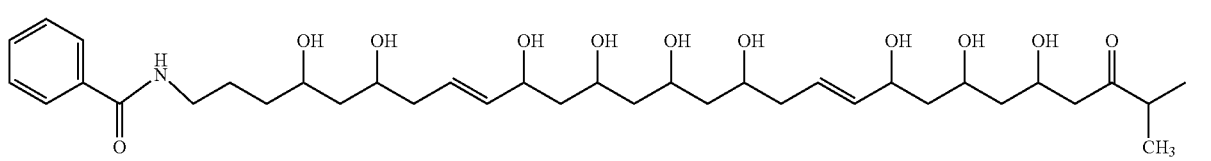

Compound 2(u)

-continued

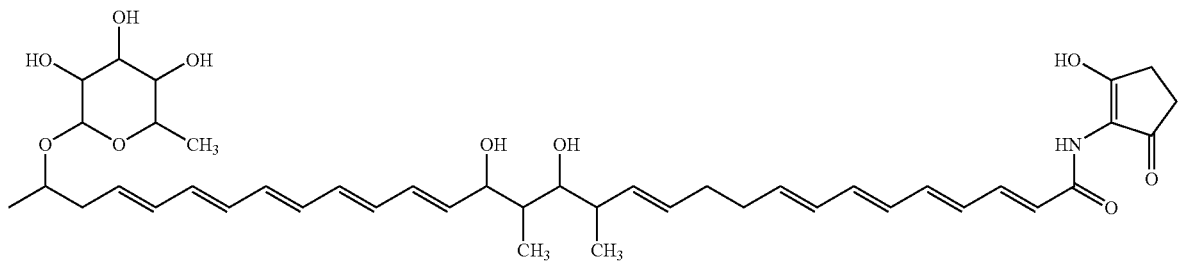

To a solution of Compound 2(a) in is added one equivalent of benzoic anhydride and two equivalents of triethylamine. The reaction is stirred at room temperature for two hours. The mixture is then diluted with water (2 volumes) and HP-20 polystyrene resin is added. The mixture is stirred for 30 minutes, filtered, the resin is washed well with water, and the product is eluted with 100% ethanol. The elutes are concentrated under vacuum to give compound 2(u).

EXAMPLE 33

Synthesis of Compound 2(v)

Compound 2(v)

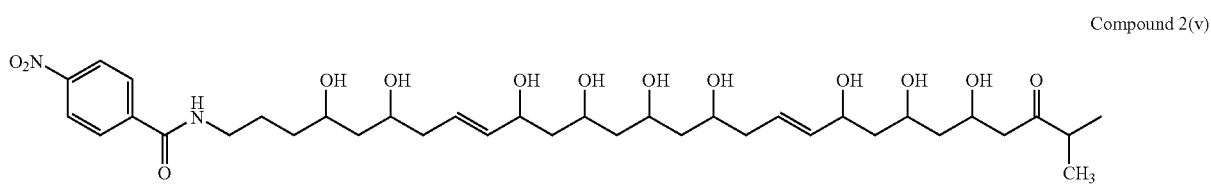

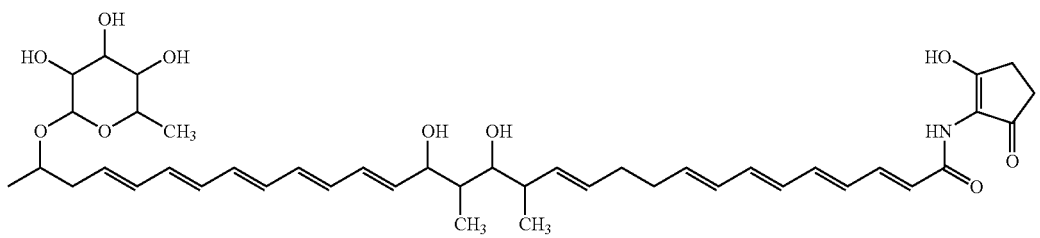

To a solution of Compound 2(a) in is added one equivalent of p-nitrobenzoic anhydride and two equivalents of triethylamine. The reaction is stirred at room temperature for two hours. The mixture is then diluted with water (2 volumes) and HP-20 polystyrene resin is added. The mixture is stirred for 30 minutes, filtered, the resin is washed well with water, and the product is eluted with 100% ethanol. The elutes are concentrated under vacuum to give compound 2(v).

EXAMPLE 34

Synthesis of Compound 2(w)

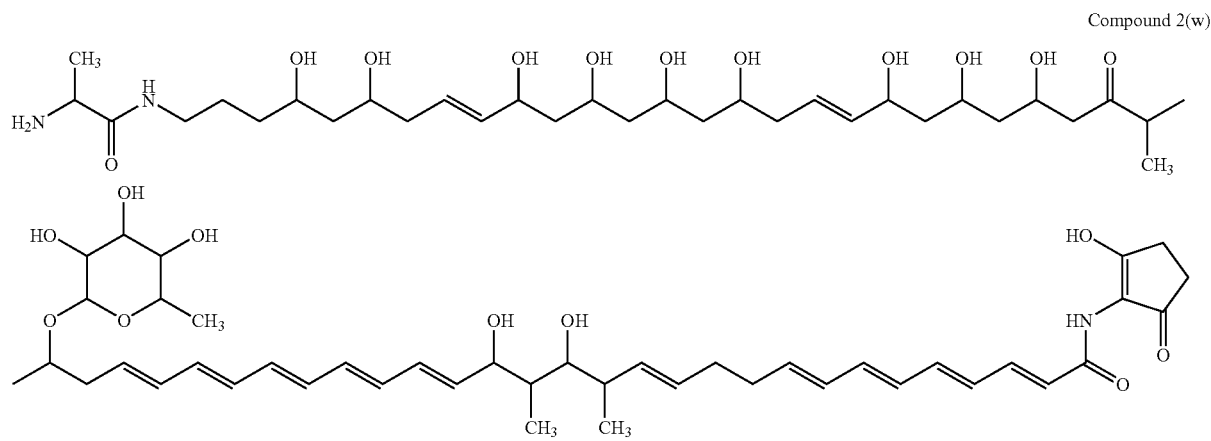

Compound 2(w)

EXAMPLE 35

Synthesis of Compound 2(x)

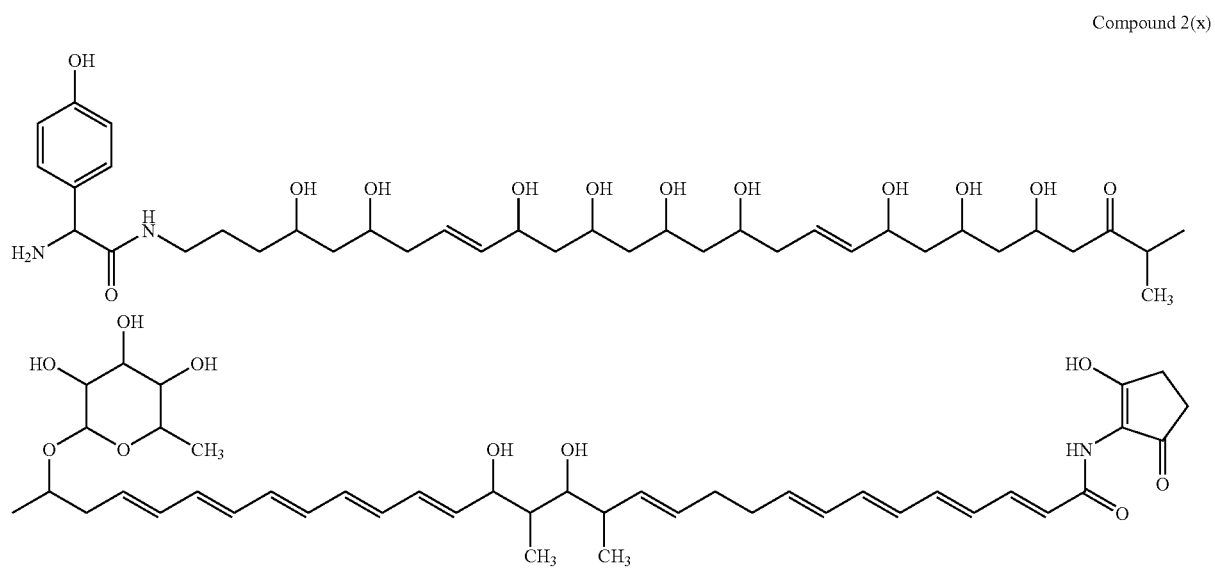

Compound 2(x)

A solution of Compound 2(a) is reacted with 1 equivalent of N-protected alanine active ester. The amino group of alanine is protected by reacting alanine with DCC (dicyclohexyldicarbodiimide) or EDC (1-ethyl-3-(3-dimethylaminopropyl)-carbodiimide) and the carboxylic acid group is converted to an active ester such as an N-hydroxysuccinimide ester. The N-protected active ester is added to Compound 2(a) in an inert solvent such as tetrahydrofuran. The mixture is warmed under reflux for one hour. The mixture is then diluted with water (2 volumes) and HP-20 polystyrene resin is added. The mixture is stirred for 30 minutes, filtered, the resin is washed well with water, and the product is eluted with 100% ethanol. The elutes are concentrated under vacuum to give compound 2(w).

A solution of Compound 2(a) is reacted with 1 equivalent of N-protected para-hydroxyphenyl glycine active ester. The amino group of the para-hydroxyphenyl glycine is protected by reacting alanine with DCC (dicyclohexyldicarbodiimide) or EDC (1-ethyl-3-(3-dimethylaminopropyl)-carbodiimide) and the carboxylic acid group is converted to an active ester such as an N-hydroxysuccinimide ester. The N-protected active ester is added to Compound 2(a) in an inert solvent such as tetrahydrofuran. The mixture is warmed under reflux for one hour. The mixture is then diluted with water (2 volumes) and HP-20 polystyrene resin is added. The mixture is stirred for 30 minutes, filtered, the resin is washed well with water, and the product is eluted with 100% ethanol. The elutes are concentrated under vacuum to give compound 2(x).

EXAMPLE 36

Synthesis of Compound 2(y)

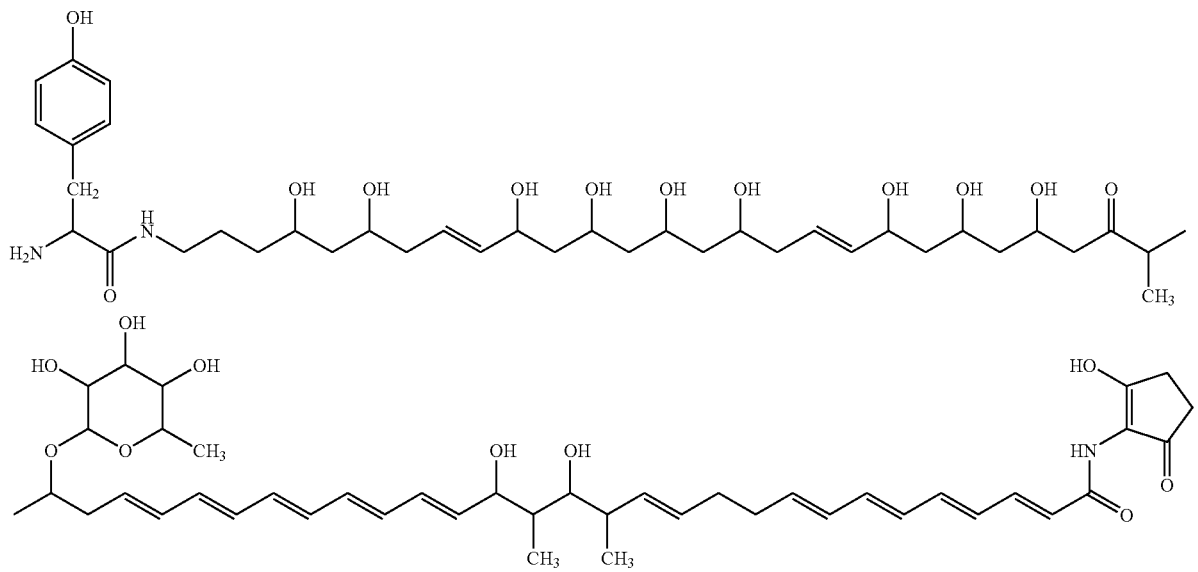

Compound 2(y)

EXAMPLE 37

Synthesis of Compound 2(z)

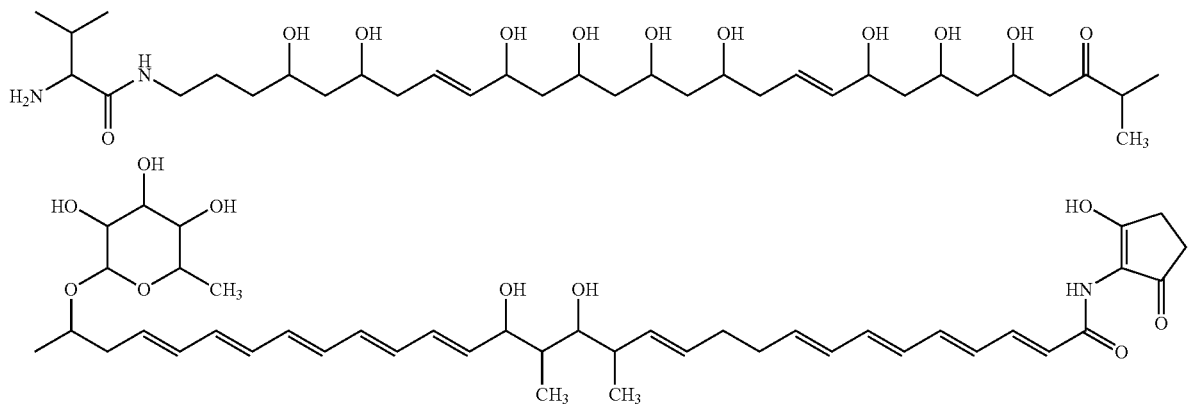

Compound 2(z)

A solution of Compound 2(a) is reacted with 1 equivalent of N-protected tyrosine active ester. The amino group of tyrosine is protected by reacting alanine with DCC (dicyclohexyldicarbodiimide) or EDC (1-ethyl-3-(3-dimethylaminopropyl)-carbodiimide) and the carboxylic acid group is converted to an active ester such as an N-hydroxysuccinimide ester. The N-protected active ester is added to Compound 2(a) in an inert solvent such as tetrahydrofuran. The mixture is warmed under reflux for one hour. The mixture is then diluted with water (2 volumes) and HP-20 polystyrene resin is added. The mixture is stirred for 30 minutes, filtered, the resin is washed well with water, and the product is eluted with 100% ethanol. The elutes are concentrated under vacuum to give compound 2(y).

A solution of Compound 2(a) is reacted with 1 equivalent of N-protected valine active ester. The amino group of valine is protected by reacting alanine with DCC (dicyclohexyldicarbodiimide) or EDC (1-ethyl-3-(3-dimethylaminopropyl)-carbodiimide) and the carboxylic acid group is converted to an active ester such as an N-hydroxysuccinimide ester. The N-protected active ester is added to Compound 2(a) in an inert solvent such as tetrahydrofuran. The mixture is warmed under reflux for one hour. The mixture is then diluted with water (2 volumes) and HP-20 polystyrene resin is added. The mixture is stirred for 30 minutes, filtered, the resin is washed well with water, and the product is eluted with 100% ethanol. The elutes are concentrated under vacuum to give compound 2(z).

EXAMPLE 38

Synthesis of Compound 2(aa)

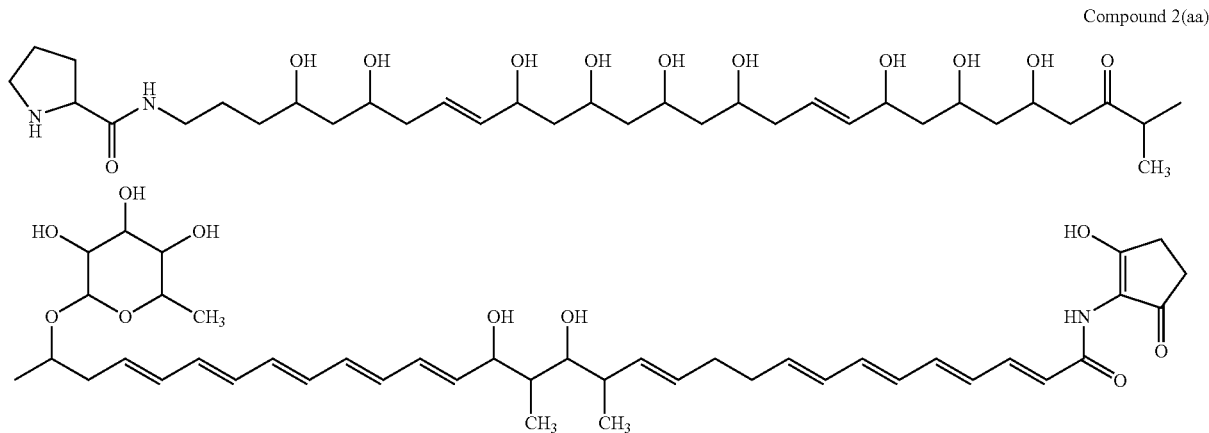

Compound 2(aa)

A solution of Compound 2(a) is reacted with 1 equivalent of N-protected proline active ester. The amino group of proline is protected by reacting alanine with DCC (dicyclohexyldicarbodiimide) or EDC (1-ethyl-3-(3-dimethylaminopropyl)-carbodiimide) and the carboxylic acid group is converted to an active ester such as an N-hydroxysuccinimide ester. The N-protected active ester is added to Compound 2(a) in an inert solvent such as tetrahydrofuran. The mixture is warmed under reflux for one hour. The mixture is then diluted with water (2 volumes) and HP-20 polystyrene resin is added. The mixture is stirred for 30 minutes, filtered, the resin is washed well with water, and the product is eluted with 100% ethanol. The elutes are concentrated under vacuum to give compound 2(aa).

EXAMPLE 39

Synthesis of Compound 2(ab)

A solution of Compound 2(a) is reacted with 1 equivalent of N-protected serine active ester. The amino group of serine is protected by reacting alanine with DCC (dicyclohexyldicarbodiimide) or EDC (1-ethyl-3-(3-dimethylaminopropyl)-carbodiimide) and the carboxylic acid group is converted to an active ester such as an N-hydroxysuccinimide ester. The N-protected active ester is added to Compound 2(a) in an inert solvent such as tetrahydrofuran. The mixture is warmed under reflux for one hour. The mixture is then diluted with water (2 volumes) and HP-20 polystyrene resin is added. The mixture is stirred for 30 minutes, filtered, the resin is washed well with water, and the product is eluted with 100% ethanol. The elutes are concentrated under vacuum to give compound 2(ab).

EXAMPLE 40

Compound 2(a) for the Treatment of Cardiovascular Disorders

Polyene compounds are not generally absorbed from the gastrointestinal tract and exhibit hypocholesterolemic properties by binding cholesterol in the gastrointestinal tract

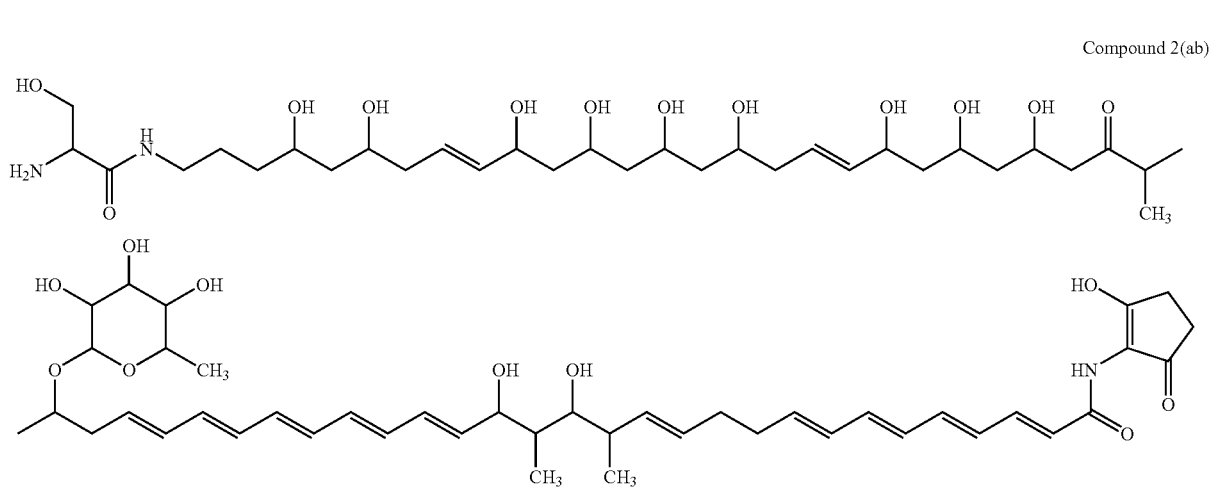

Compound 2(ab)

following oral administration. The hypocholesterolemic properties of polyene compounds was first demonstrated by studies in dogs (Schaffner, C. P. and Gordon H. W. The hypocholesterolemic activity of orally administered polyene macrolides. P.N.A.S. 61:36-41,1968.). In another study with chickens, small amounts of polyene compounds in the diet led to the inhibition of enterohepatic cholesterol circulation, increased fecal lipid excretion and reduced atherogenesis (Fisher, H., Griminger P. and Siller W. Effect of candicidin on plasma cholesterol and avian atherosclerosis. Proceedings of the Society for Experimental Biology and Medicine, 145: 836-839, 1974). The beneficial effects of orally administered polyene compounds on cholesterol-lipid metabolism is not species-dependent as it was demonstrated in several species including humans, rats, dogs and chickens (Pagliano F M, Correction of hyperdyslipidemia using polyene-structure substances. Controlled clinical trial. Arch Sci Med (Torino). 136: 303-308,1979; Barbaro A. and Casella G. Action of a polyene macrolide on hyperdislipidaemic disorders. Archivio per Scienze Mediche 137: 211-216,1980; Singhal, A. K., Mosbach, E. H. and Schaffner, C. P. Effect of candicidin on cholesterol and bile acid metabolism in the rat. Lipids, 16: 423-426,1981.).

The therapeutic potential of compound 2(a) for the treatment of cardiovascular disorders such as high cholesterol, dyslipidemia and atherosclerosis is demonstrated by measuring the effects of oral administration of compound 2(a) to rabbits. New Zealand rabbits are maintained under controlled light and temperature conditions and fed for several weeks with two different diets: normal rabbit chow (control) and a diet containing 0.5 to 1% cholesterol to induce hypercholesterolemia. Rabbits are administered compound 2(a) (3, 10, 30 mg/kg) or vehicle by oral gavage daily for up to one month. Food intake and rabbit weight is measured daily for the duration of the experiment. Blood samples to measure cholesterol, lipoproteins and triglycerides are collected through a catheter inserted in the ear artery in the beginning and at the end of the experiment as well as every 4 days for the duration of the experiment. Serum cholesterol, lipoproteins and triglycerides are measured by enzymatic assays employing commercial kits as specified by the manufacturer (Sigma Chemical Co) and as described in Staprans I, Pan X-M, Rapp J H, Feingold K R. Oxidized cholesterol in the diet accelerates the development of aortic atherosclerosis in cholesterol-fed rabbits. Arteriosclerosis, Thrombosis and Vascular Biology, 18: 977-983, 1998. At the end of the experiment, after collecting the final blood sample, animals are anesthetized and the descending aorta is exposed, excised and processed for histological examination following fixation in formalin. Briefly, paraffin longitudinal or cross sections (five micron) are stained with Sudan black (dying lipids) and counterstained with Masson trichrome. Morphometric quantitative determination of the area of the intima, media and adventitia layers is performed by image analysis. Lipid deposition in the aorta is determined by evaluation of the percentage of the aorta covered by lesions visualized by fat staining. Arterial concentration of cholesterol is measured after extraction of lipids as described in Thiery J, Nebendahl K, Rapp K, Kluge R, Teupser D and Seidel D. Low atherosclerotic response of a strain of rabbits to diet-induced hypercholesterolemia. Arteriosclerosis, Thrombosis and Vascular Biology, 15: 1181-1188,1995.

SEQUENCE LISTING (78 sequences)

SEQ ID NO: 1 - DNA, 11740 bp, Streptomyces aizunensis
gatcatggccggcgaggtggtcgcgggcggggcgaatccgaaggtcacggtcctcccttcgggttacgcgcgccgctgacgggcacggctgggttgcgggcgcgccgcagcgcggccctcaagagtgccgacgagccgagcgggaacactccaattctcgcgcggcccgcgaggatgcggcaacgagcaattggcgccgcggaccgtaattggccggtatgccgttcatatccttgccccgttacgccgtcgatgacgcatccggtgccgcccggaccgccggtaccagcggaaacacctcccgcgcggcggcccgctggagccgcggagatccaccggacaccccctgggcctggcggagtccgtgcgtgccgcgtggattcgccgattgtcggtgggatcgggttgcatgggggcatggacaacctggagctccgtcgtgaagccgatgccatcctcgctgagctggtcggtgcccctgggggttcggcgcggctgcgggaggaccagtggcaggcggtcgcggccctggtggaggagcgccggcgggccctggtggtgcagcgcacgggctggggcaagtccgcggtctacttcgtcgccaccgctctgctgcgccggcgcggctccgggccgacggtgatcatttctccgctgctggcgctgatgcgcaaccaggtcgaggcggccgcgcgggccgggatccaggcgcgcacgatcaactcggccaacccggaggagtgggaaaccatctacggggaggtcgagcgcggcgagaccgatgtgctcctcgtcagccccgagcgcctcaactccgtggatttccgcgaccaggtactgcccaagctggcggccacgacgggtctgctggtggtcgacgaggcgcactgcatctccgactggggccacgacttccgccccgactaccgacggctgcgcacgatgctggcggagctgccggagggcgtgccggtcctggccacgacggcgaccgcgaacgcgcgggtgaccgcggacgtggcggagcagctgggcacgcacggcgagcacgccctggtcctgcgcggaccgctcgaccgggagagcctgcggctgggagtgctgcagctgccggacgcggcgcaccggctggcctggctgggggaccggctggcgcacctgccgggttcggggatcatctacacgctgaccgtggcggcggcggaggaggtcgcggcgttcctgcggcaacgcgggtatccggtggcttcctacaccgggaagacggagaacgccgaccggttgcaggcggaggaggatctgctggcgaaccgggtgaaggcactggtggcgacctcggcgctgggcatggggttcgacaagccggacctggggttcgtggtgcacatggggtcgccctcgtccccgatcgcctactaccagcaggtggggcgcgcggggcgtggggtggatcacgcggacgtgctgctgctgccgggccgggaggacgaggcgatctgggcgtacttcgcctcggtgggcttcccgcccgaggagcaggtccggcgcaccctggacgtactggcgcaggcgggccgcccgctgtcgctgcccgcgctggagccgctggtggacctccggcgctcgcgcctggagacgatgctgaaggtcctggacgtggacggcgcggtcaagcgcgtgaagggcggctggaccgccaccgggcagccgtggacgtacgacgcggagcggtacgcctgggtcgcgaagcagcgggcggcggagcagcaggccatgcgggactacgtggcgaccacgggctgccggatggagttcctgcagcggcagctggacgacgagaaggcggtcccgtgcggccgctgcgacaactgcgccggatcctggctggaggcggtcgtgtcgcccgcggccctcgcggccgcggcgggcgagctggaccgcgcgggggtcgaggtcgagtcccgcaagatgtggccgaccgggctcgccgcggtcggcatggacctgaagggccggatccccgcgggccagcaggccgtcaccgggcgcgcgctcggcaggctgtcggacatcggctggggcaaccggctgcgccccctgctgtcggcgcaggccgcggacgggccggttccggacgatgtgctggccgccgtcgtgacggtgctcgccgactgggcccgctcgccgggcggctgggcgagcggcgggccggacgcgatggcgcggccggtggggatcgtcgccatgccctcccgtacccgcccgcggctggtcgcctcgctggccgagggcgtggcccgggtcggcaggctcccgctgctgggcagcctcgcctacaccccgcaggccgacgtgtacggggcgcaccgcagcaactcagcccagcggctgcgcgccctggccgactcgttcaccgtgcccgaggaactcgccgcggccctggccgccgctcccggcccggtcctgctcgtcgacgactacaccgactccggctggaccctggccgtgggcgcacgcctgctgcgccagtccggcgcgggcggcgtgctcccgctcgtcctcgcgctggccgggtaggcggactccaccggcctcggcctatcgccaaccgacggggggcggcaagatcaaaacaaccgcccgtaaagcaaacgtaaagatgtggcttctttgggaagtcgcgtatgggcctgttttgagccacgcggcggaagtcacccctggcgggatccgtggtggcgcattcggtgcggacggccgaacgggccgtcgtcgctcccgttcgggccggggggccctgtcgtcgcacggggagagcgaatgccggccggggctgcggaccgggaggttccagccagggtaggggtagaaagtaggggtactccccgccttgatcgtcctggtagacatgacacatccgaaacgcgcgtgcggaagtggcggaagggttcgacccgtcgaacgggcgcgctgcatctggggcttgaacagggagtttcagtccgttgaataagcaagaaactagcctctgggttcgccgctaccacgcttcggacgaaagccggatccaattggtctgtctgccgcacgccggtggctcggcctccttctacttccccatgtcccagtcgctggctccggcgatggacgtcctctcggtccagtaccccggcaggcaggaccgcagggacgagcccgggatcgtggacatcggcgcctacgcggacgccctgaccgagcaactcgtaccgtggctcgaccggcccctggccttcttcggccacagcatgggtgcgatcctcgccttcgaggtgacgcgcaggctggagcgtgaccacggcgtcactccggagcacatcttcgcttccggccggcgctcgcccgccagtttccggcacgagaccgtgcacctgcgggacgacgacggaatcgtggcggaaatgcgggaactcagcggaaccgacgcgaagatactcggcaacgaggaaatcctccgcatggtgctccccgcgattcgaagcgactacaccgccatcgagaactaccgtgccgcgccggaagacgtcgtgcgtactcccatcacggtgctgaccggtgacgcggacccgaggaccagccgggaagaggcggacgcctggaaggcgcacacgaccggcggattcgatctgcattccttccccggtggacatttcttcctggcgaatcaccaggagaagatcatgggaattatttcggaggaactctccgcgccggctcgcatggcgtgagcagagagctgtggaccaggccggggaaacccggctcgccccttgccgacctccaccgcgatggcggagccgagaagccgaatgaccaacggccgcggtggcgatcgaaaggggcaggccgcggtgacggcccgccggtgcacaccgtgcaccggcacaccaagcggtgcggcggcggcttcgccgggcgcccaccgggcccgttgcgaagtcttcgcaagtcgtgcagttcgggggaaaggaagcccgtggcggttaggctcgtcgagcgcgagaagcagctggaaacgctgaaggaactactcggcagcgcagtccgtggccgagggcgggtcgccgtcatcagcggggcagtcgccggcgggaaaacgagtctgctggaaatcttcaccgaagaggcgatctccgcgggcgcgctggtgctggaagccacgggctcccgggcggagcgctatctgcccttcggaattctgcgcagaatcctcgacagcgcggcgcccctgtcgcccgagatccacgcctacgccaccgagctgctggaccgcgtcagcgccgggacgacggacgccgaaggcgccgtcgaggccggtatgcgcgtcctgccccatgtcgccaccgcactgttaaggatcgcccggaaccggaccgtcgtcatagccatcgacgacgtccaccacggggacgaactctccctcgccttcctgctgtgcctcgcccgccgagtgcgccaggcgggcgtcctgatcgtgctcaccgaagccgtccggctgcggtccgcgcaactcgccttccacgccgaactgcagcgccagcccaactgcaccagcctccggctgcccctgctcaccacgcgcggcaccacccgcgtcctcgccgagcacttctccccctcgacggcgcaacggctgtccgccgagtgccaggagaccaccggcggcaatccactgctggtcagggcgctgatcgacgacggcctcacggcgctcggagacagcgagcccttccagcggctcgcccccgccgaaaccttcgaacgcgccgtgctcgactgcctgcaccgcggcgaccccgagctgctgaccgtcgcccggggcgtcgccgtactcggtagcgcctgctccttggccctgctcaacgggatcgtcgacctgcacgccaaggccaccgaacaggcccttcaggacctcagccggtgcgccgtcctgcaccacggctccttccgcgacccggcggcccgtaccgccgtcctggaagccactccgcccgcggcgctgtccgccctgcacctgcgcaccgcgcgactcctgcaccaggaaggcgcgacggcgctcgatgtcgcccgccacctcctcgccgcccgcaagaacgtcgaggactgggcgatccccgtcctccaggaggcggtcgagtacgccctcgtcgaggacgagcacgaactcgccctgcggtgcggggaactggcggtcgcctcctgcgcggagggcccccgacacgccgccctgaagtcccgcctggcgagcatcgtctggcgcagcagcccggccgccgctgaagggcatctgcggcagctgtcccgcgaactcgccgccggccggctcgccgaccgcgatctcgtccaggccgtgtcgctcctggcgtggatgggggagtcccggggggccggcgaggcggtactgcgactgcagcggaccgacagcgaggccgaggcggccggacgggcgcccgcctacgacccgggcacgctcaccgccgcacagagctggctctcgatggtcagcccgccggcccgcgacctcttcgacgccgtggaaccgcgccggacaacgctgtcaggcgcgccgggggcgctgcccggcgcggggcccgacaccgtcccctacgacatgcccgacaacgcctacgtccaggccgccgacgccgtccgcaccgccctgcgcggcggaacccaggccgacgccgccgtcagcaaggccacccgggtgctccagcgctaccacctgagcgaccgcaccctccagccgctcgtcttcgccctcctcgccgtcatctacgcgggtcgcctcgacctcgcgtccgcctggtgcgaacgactgctcggcgagtgctccgcccgcaacgccccgacctggcaggccgccctcggtgtggtccgggccgagatcctgctgcgccagggcgatctgcccggtgcggccgcccaggcccgccacgccatgtcccggatctccctgcagagctggggcgtgggcatcgcgctgccgctggccgtcctcgtcgaggccgaggtccagatgggcgaccacgaggaggcgatgagcctgctcgaacagccggtgccccaggccatgttcgacaccctggccggcctgcactacctcagggcccgcggccgctgccacctggccaccggccgctaccacgccgccgtgcgggacttcctgaactgcggcgagctgatgcaggcctggggcgtggacggggcggagctggtgccgtggcggctggacgccgccgaggcgtggctggccctcggcaacgtcgcgcgcgccaaggagtacaccgagcagcagaagcagcgcgagacggggcccgtgggcagccggacgcgtggctccctgctgctcacgctcgcccacaccggcggtgacctcacggtccggctcaagcggctcgtcgaggccgtcgagaccctggaggagggcggggaccggctccagctggcggtggcgctgggggagctgggccgcggctaccgtgcgctgggcgacttcaaccgggcccggatgctggtgcgcaaggcctggcacgtcgccaagtcctgcggcgccgaaccgctgtgccagcagttcatgccggggcaggtcgacggcgaggccggtgcgcagagcggccgggaggcggagcttcccagcgaggtcgaggtcctgtccgaggccgaggcgcgggtcgcgctgctggcggcgcgcggccacaccaaccgtgagatagcgaccaagctctacgtcacggtgtccacggtcgagcagcatctgacgcgcatctaccgcaagctgaaggtgaagcggcgccgcgatctgcccgcccggctgtcggacctgagcctgccgagcatcgcctgaccgcgcccgtcgccgggagcgcgttgcgggagcgcgttgcccggagcgcggcgccacgcgcggcgcccgccgcccgcgggccgcacccgtcaggacagcaggccgagcttcagtgccgtgatcaccgcggccgtccggtccgagaccgacagcttcttgaacgagcgcagcagatgcgtcttcaccgtcgcctcgctgatgaacagctggcggccgatgtccgcgttggtcagcccgaggctgaccaactggagcacctcgcgctcacggtccgacagcgcgggcggctccaccacccgggcccggaacagcttgggggcgagcgacggcgtcaggaccgtctcaccgcgggccgccgcctttaccgcctgcaccagttcgtcgcgcgagctgcccttgagcaggtagcccgccgcgcccgcctccacggcccgcaggatgtccgtgtcgctctcgtacgtcgtcacgatcaccaccttggtggccggcgcgacgcgcagcaggtggccggtggtctccaccccgtccatcccgcccatctgaaggtcgagcaggacgatgtcgggagcaagtctggtgaccatcgcgatcgcctcctcgcccgagtcggcctgcccgacgacgctcacgccgtcggcggattgcagcatcgagctgagaccctcccgtacgaccgggtggtcgtcgaccagcatcacaccgatcgtcttgtcagcgctcatcggcttcctctcccttcgcgggcacgggcaccgtcacttcgatggtggtgccctgtccggggctgctgaccacggtcgccgccccgctgatctcgtgtgcgcgagtctgcatgccgcgcagcccgcttccccgctggtccccggtgacggtgaacccgggtccgtcgtcccgtacgagcagccgtacggtgtcctgttcgtacacgagccggatctcggccgcgcgtgccttccccgcgtgcttgcggatgttcgcgatggcctcctggagggaacgcagcaggaccacgctgatcgccatcggcagttcccgctcgtctccttcgacggtgacgtgcgcccgcatgccggtctgcgccgtcaggccctcggcctgccgccgcgtcgcctgcacgagcgaggactcctgcagcgcgggcggggtcagctcggtgacgaactcgcgggcttctcccaggctttcgcgggccacgcggcccgccagtgccagatgcgccctcgcccggtccgggtcggccgtgaagtcggtctcggcggcctgtacgaggctgatgatgctggtgaggccctgggcgagggtgtcgtggatctcccgggcgagccgctcgcgctcggcggagacccccgccttgcgcgacagccgggcgacttgcgcacggttgcggtgcaactcctcgatgagctcggcccggtcacggctctgccgggtcacccgggtgatccacagcccgagcatgaccgacagggcgatgccgaggagcgaggtcggcaggacggccaggatgtcgcggctcagggtgccgccgcgcagccacaccacgatgaccggaaccagattggccagcgtgaccacggcgatggccggcgaggtcgccaggctcatcatcagcatcgggaccacggcgaacagcgcgaacgaggccgcgaggtcgaagaccacggccaccgcgaacagcacgaacaggccgacggagaagacgacgctgcgccggacgggcccctggccctcgtggaccatggtgctgcgccccagggccgcgtaccagggcacggccgcggtcagcgcggccatggccacggcccggtggacctgttcaccgtcggaggtgaacagcagcatggtggtgacggcgtacgagaccgcgaagagcgcgtcccacaggccgaaccaccgggctcccgcctcgggcgcgtcgtcctggccgtctgtcgcctgcgccgcgggggattcagtgctcacccgacaagtcctatcacttcggtcgggcacggtacgagggcggcccggcgccgtccaccgtgtccaccggtcggtggacagccgaacccactggtcggttgtcctcgcgtcccttgcccgccgcctaacgttgcaggtgagaggcacgaagcgaccgcactgccggagagaaggcagtgccgaggaagaggaagaggtcatcccctgagcccgttcttgaacacactgatcgccagcgggacgatcttggccgtcattctgtcgaccgacctcggcacccgcaaagtcaccacgacgcggatgcttccttcgctcctcgcggtcgtcgtgatcctcgcgctcctcgtgcacacactgccgctcgacggcaacgacccctcgctccaactggcgggcatcggcgccggtatcatctgcggactggccgccacggcgctcctccccgcccaccggaacgcttccggtgaggtctccaccaagggcggtatcggttacgcgctggtgtggaccgcgctgtccgcctcgcgtgtgctcttcgcctacggttcacagcactggttcagcgagggcatcgtccggttcagcaccgactacaagctcagcggacaggccgtctactccaacgctttcgccttcatggccctggccatggtgctgacgcggaccgccgtcctgttgaacacgcgccgccggctgcgcggcgggcagcttcccgcggccgacaacacggccccacatcaggcgagttccgccaatacgcactgacatgacggagcgtcagatccggcttgggtgcaagatcgtctcagaactagggtgaagcagtgaaacacatgcatgatgtcaggctccggcccccgcgcaatcgtgtcgactcccgggcagtgggctggtggacggtccagtccgcgatgtacgccctgcccctgccgatcaccttcggcgtgctgtacctgtgcatcccgcccgccaggccgttcttcggctgggccttcctgatctcgctcgtaccgggcctcgcctacatggccgtcatgcccgcctggcgctaccgggtgcaccgttgggagaccaccgacgaagccgtctacgcggcgtccggctggctctggcagcagtggcgggtcgtgccgatgtcccgcatccagacggtggacaccctgcgcggacccctccagcagctcttcggcctctccggcatcaccgtcaccaccgcctcctactccggcgccgtgaagatcaagggaatcgaccaccggaccgcgcgggacgtggtcgagcacctcaccagggtgacccaggccacccccggagacgcgacatgagccacgacaccggacagtgggaggccaccgcgacctcccacggcgccgccgaagaccccgagtggagcaggctcagcccccgactgctgctggtcaacctgagcatgctcgccggcccgctcgccctgttcgccgtcacggtcgccctgaccggcgccaacctccaggccctcatctccctcggctccctgctgatcgtcttcctggtcatcaccgggatcagcacgatgcggctgctgaccacccgcttccgcgtcaccgccgaacgcgtcgaactgcgctcgggcctgctcttccgcagccgccgctcggtccccatcgaccgggtccgcagcgtcgacgtcgaagccaagccggtgcaccgcctcttcggcctcgcctcgctgcgcatcggcaccggtgaacagggcgcgtccagccgcaggctctccctcgacggcatcaccaggcgtcaggcgcggcgactgcgcaggctcctcatcgaccgccgtggcagcggccatgccaccggccaggaccaggacgtcaccatcgccgagatggactgggcctggctgcggtacgcgccgctcaccatctggggcgtcggcagcgtcttcgccgccgtcggcaccgcctaccgcatcctgcacgagatgaaggtcgacccgctcgaactgggcgtcgtcaaggacatcgaggaccgcttcggttccgtacccctgtggttcggcatcctcgtcgccgtcgtgatcaccgccgtcgtgggcgccgcggtctccaccgccaccttcgtggacgcctggaccaactaccgcctggagcgtgagggggtcggcatcttccggatccgccgcggactgctcatttcccgctccgtcaccatcgaggagcgccggctgcgcggcgtcgagctcgccgagccgatgctgctgcgctgggcgggcggcgccaccctgagcgccatcgccagcggcctcagcaacagccaggagaaccgcagccgctgttccctcaccccgcccgtgccccgggacgaggcgctgcgggtcgccgccgacgtcctcgccgaggaagggtccccgacggagctgaccaagctcgtccggcactcccgtgccgccctgcgccgtcgcatcaaccgcggcctgctggtcctcgcggccgtcgtcgcggtgccgctgggcctggggctgtggctcacccccgtcctggtgcacaccgcctggatcacggcgctcgtcggcctgccggtcgtcatcgtcctcgccaacgacgcctaccgctccctcggccacggaatccgcgaccgctacctcgtcgtccgcgccggcaccttcgcccgccgtacggtcgccgtccagcgggacggcgtcatcggctggaacatctcccgctcctacttccagcggcgcagcggactgctcaccatcggcgccaccaccgcgggcgtcggctgccacaaggtgcgcgacgtatccgtcggcgccggcctcgccttcgccgaagaggccgtacccaggctgctcgccccgttcatcgaacgcgtcccgcgcggctgaaccccctcagaccaactggcgaaccc

SEQ ID NO: 2 - protein, 719 aa, Streptomyces aizunensis
MDNLELRREADAILAELVGAPGGSARLREDQWQAVAALVEERRRALVVQRTGWGKSAVYFVATALLRRRGSGPTVIISPLLALMRNQVEAAARAGIQARTINSANPEEWETIYGEVERGETDVLLVSPERLNSVDFRDQVLPKLAATTGLLVVDEAHCISDWGHDFRPDYRRLRTMLAELPEGVPVLATTATANARVTADVAEQLGTHGEHALVLRGPLDRESLRLGVLQLPDAAHRLAWLGDRLAHLPGSGIIYTLTVAAAEEVAAFLRQRGYPVASYTGKTENADRLQAEEDLLANRVKALVATSALGMGFDKPDLGFVVHMGSPSSPIAYYQQVGRAGRGVDHADVLLLPGREDEAIWAYFASVGFPPEEQVRRTLDVLAQAGRPLSLPALEPLVDLRRSRLETMLKVLDVDGAVKRVKGGWTATGQPWTYDAERYAWVAKQRAAEQQAMRDYVATTGCRMEFLQRQLDDEKAVPCGRCDNCAGSWLEAVVSPAALAAAAGELDRAGVEVESRKMWPTGLAAVGMDLKGRIPAGQQAVTGRALGRLSDIGWGNRLRPLLSAQAADGPVPDDVLAAVVTVLADWARSPGGWASGGPDAMARPVGIVAMPSRTRPRLVASLAEGVARVGRLPLLGSLAYTPQADVYGAHRSNSAQRLRALADSFTVPEELAAALAAAPGPVLLVDDYTDSGWTLAVGARLLRQSGAGGVLPLVLALAG

SEQ ID NO: 3 - DNA, 2160 bp, Streptomyces aizunensis
atggacaacctggagctccgtcgtgaagccgatgccatcctcgctgagctggtcggtgcccctgggggttcggcgcggctgcgggaggaccagtggcaggcggtcgcggccctggtggaggagcgccggcgggccctggtggtgcagcgcacgggctggggcaagtccgcggtctacttcgtcgccaccgctctgctgcgccggcgcggctccgggccgacggtgatcatttctccgctgctggcgctgatgcgcaaccaggtcgaggcggccgcgcgggccgggatccaggcgcgcacgatcaactcggccaacccggaggagtgggaaaccatctacggggaggtcgagcgcggcgagaccgatgtgctcctcgtcagccccgagcgcctcaactccgtggatttccgcgaccaggtactgcccaagctggcggccacgacgggtctgctggtggtcgacgaggcgcactgcatctccgactggggccacgacttccgccccgactaccgacggctgcgcacgatgctggcggagctgccggagggcgtgccggtcctggccacgacggcgaccgcgaacgcgcgggtgaccgcggacgtggcggagcagctgggcacgcacggcgagcacgccctggtcctgcgcggaccgctcgaccgggagagcctgcggctgggagtgctgcagctgccggacgcggcgcaccggctggcctggctgggggaccggctggcgcacctgccgggttcggggatcatctacacgctgaccgtggcggcggcggaggaggtcgcggcgttcctgcggcaacgcgggtatccggtggcttcctacaccgggaagacggagaacgccgaccggttgcaggcggaggaggatctgctggcgaaccgggtgaaggcactggtggcgacctcggcgctgggcatggggttcgacaagccggacctggggttcgtggtgcacatggggtcgccctcgtccccgatcgcctactaccagcaggtggggcgcgcggggcgtggggtggatcacgcggacgtgctgctgctgccgggccgggaggacgaggcgatctgggcgtacttcgcctcggtgggcttcccgcccgaggagcaggtccggcgcaccctggacgtactggcgcaggcgggccgcccgctgtcgctgcccgcgctggagccgctggtggacctccggcgctcgcgcctggagacgatgctgaaggtcctggacgtggacggcgcggtcaagcgcgtgaagggcggctggaccgccaccgggcagccgtggacgtacgacgcggagcggtacgcctgggtcgcgaagcagcgggcggcggagcagcaggccatgcgggactacgtggcgaccacgggctgccggatggagttcctgcagcggcagctggacgacgagaaggcggtcccgtgcggccgctgcgacaactgcgccggatcctggctggaggcggtcgtgtcgcccgcggccctcgcggccgcggcgggcgagctggaccgcgcgggggtcgaggtcgagtcccgcaagatgtggccgaccgggctcgccgcggtcggcatggacctgaagggccggatccccgcgggccagcaggccgtcaccgggcgcgcgctcggcaggctgtcggacatcggctggggcaaccggctgcgccccctgctgtcggcgcaggccgcggacgggccggttccggacgatgtgctggccgccgtcgtgacggtgctcgccgactgggcccgctcgccgggcggctgggcgagcggcgggccggacgcgatggcgcggccggtggggatcgtcgccatgccctcccgtacccgcccgcggctggtcgcctcgctggccgagggcgtggcccgggtcggcaggctcccgctgctgggcagcctcgcctacaccccgcaggccgacgtgtacggggcgcaccgcagcaactcagcccagcggctgcgcgccctggccgactcgttcaccgtgcccgaggaactcgccgcggccctggccgccgctcccggcccggtcctgctcgtcgacgactacaccgactccggctggaccctggccgtgggcgcacgcctgctgcgccagtccggcgcgggcggcgtgctcccgctcgtcctcgcgctggccgggtag

SEQ ID NO: 4 - protein, 253 aa, Streptomyces aizunensis
LNKQETSLWVRRYHASDESRIQLVCLPHAGGSASFYFPMSQSLAPAMDVLSVQYPGRQDRRDEPGIVDIGAYADALTEQLVPWLDRPLAFFGHSMGAILAFEVTRRLERDHGVTPEHIFASGRRSPASFRHETVHLRDDDGIVAEMRELSGTDAKILGNEEILRMVLPAIRSDYTAIENYRAAPEDVVRTPITVLTGDADPRTSREEADAWKAHTTGGFDLHSFPGGHFFLANHQEKIMGIISEELSAPARMA

SEQ ID NO: 5 - DNA, 762 bp, Streptomyces aizunensis
ttgaataagcaagaaactagcctctgggttcgccgctaccacgcttcggacgaaagccggatccaattggtctgtctgccgcacgccggtggctcggcctccttctacttccccatgtcccagtcgctggctccggcgatggacgtcctctcggtccagtaccccggcaggcaggaccgcagggacgagcccgggatcgtggacatcggcgcctacgcggacgccctgaccgagcaactcgtaccgtggctcgaccggcccctggccttcttcggccacagcatgggtgcgatcctcgccttcgaggtgacgcgcaggctggagcgtgaccacggcgtcactccggagcacatcttcgcttccggccggcgctcgcccgccagtttccggcacgagaccgtgcacctgcgggacgacgacggaatcgtggcggaaatgcgggaactcagcggaaccgacgcgaagatactcggcaacgaggaaatcctccgcatggtgctccccgcgattcgaagcgactacaccgccatcgagaactaccgtgccgcgccggaagacgtcgtgcgtactcccatcacggtgctgaccggtgacgcggacccgaggaccagccgggaagaggcggacgcctggaaggcgcacacgaccggcggattcgatctgcattccttccccggtggacatttcttcctggcgaatcaccaggagaagatcatgggaattatttcggaggaactctccgcgccggctcgcatggcgtga

SEQ ID NO: 6 - protein, 956 aa, Streptomyces aizunensis
VAVRLVEREKQLETLKELLGSAVRGRGRVAVISGAVAGGKTSLLEIFTEEAISAGALVLEATGSRAERYLPFGILRRILDSAAPLSPEIHAYATELLDRVSAGTTDAEGAVEAGMRVLPHVATALLRIARNRTVVIAIDDVHHGDELSLAFLLCLARRVRQAGVLIVLTEAVRLRSAQLAFHAELQRQPNCTSLRLPLLTTRGTTRVLAEHFSPSTAQRLSAECQETTGGNPLLVRALIDDGLTALGDSEPFQRLAPAETFERAVLDCLHRGDPELLTVARGVAVLGSACSLALLNGIVDLHAKATEQALQDLSRCAVLHHGSFRDPAARTAVLEATPPAALSALHLRTARLLHQEGATALDVARHLLAARKNVEDWAIPVLQEAVEYALVEDEHELALRCGELAVASCAEGPRHAALKSRLASIVWRSSPAAAEGHLRQLSRELAAGRLADRDLVQAVSLLAWMGESRGAGEAVLRLQRTDSEAEAAGRAPAYDPGTLTAAQSWLSMVSPPARDLFDAVEPRRTTLSGAPGALPGAGPDTVPYDMPDNAYVQAADAVRTALRGGTQADAAVSKATRVLQRYHLSDRTLQPLVFALLAVIYAGRLDLASAWCERLLGECSARNAPTWQAALGVVRAEILLRQGDLPGAAAQARHAMSRISLQSWGVGIALPLAVLVEAEVQMGDHEEAMSLLEQPVPQAMFDTLAGLHYLRARGRCHLATGRYHAAVRDFLNCGELMQAWGVDGAELVPWRLDAAEAWLALGNVARAKEYTEQQKQRETGPVGSRTRGSLLLTLAHTGGDLTVRLKRLVEAVETLEEGGDRLQLAVALGELGRGYRALGDFNRARMLVRKAWHVAKSCGAEPLCQQFMPGQVDGEAGAQSGREAELPSEVEVLSEAEARVALLAARGHTNREIATKLYVTVSTVEQHLTRIYRKLKVKRRRDLPARLSDLSLPSIA

SEQ ID NO: 7 - DNA, 2871 bp, Streptomyces aizunensis
gtggcggttaggctcgtcgagcgcgagaagcagctggaaacgctgaaggaactactcggcagcgcagtccgtggccgagggcgggtcgccgtcatcagcggggcagtcgccggcgggaaaacgagtctgctggaaatcttcaccgaagaggcgatctccgcgggcgcgctggtgctggaagccacgggctcccgggcggagcgctatctgcccttcggaattctgcgcagaatcctcgacagcgcggcgcccctgtcgcccgagatccacgcctacgccaccgagctgctggaccgcgtcagcgccgggacgacggacgccgaaggcgccgtcgaggccggtatgcgcgtcctgccccatgtcgccaccgcactgttaaggatcgcccggaaccggaccgtcgtcatagccatcgacgacgtccaccacggggacgaactctccctcgccttcctgctgtgcctcgcccgccgagtgcgccaggcgggcgtcctgatcgtgctcaccgaagccgtccggctgcggtccgcgcaactcgccttccacgccgaactgcagcgccagcccaactgcaccagcctccggctgcccctgctcaccacgcgcggcaccacccgcgtcctcgccgagcacttctccccctcgacggcgcaacggctgtccgccgagtgccaggagaccaccggcggcaatccactgctggtcagggcgctgatcgacgacggcctcacggcgctcggagacagcgagcccttccagcggctcgcccccgccgaaaccttcgaacgcgccgtgctcgactgcctgcaccgcggcgaccccgagctgctgaccgtcgcccggggcgtcgccgtactcggtagcgcctgctccttggccctgctcaacgggatcgtcgacctgcacgccaaggccaccgaacaggcccttcaggacctcagccggtgcgccgtcctgcaccacggctccttccgcgacccggcggcccgtaccgccgtcctggaagccactccgcccgcggcgctgtccgccctgcacctgcgcaccgcgcgactcctgcaccaggaaggcgcgacggcgctcgatgtcgcccgccacctcctcgccgcccgcaagaacgtcgaggactgggcgatccccgtcctccaggaggcggtcgagtacgccctcgtcgaggacgagcacgaactcgccctgcggtgcggggaactggcggtcgcctcctgcgcggagggcccccgacacgccgccctgaagtcccgcctggcgagcatcgtctggcgcagcagcccggccgccgctgaagggcatctgcggcagctgtcccgcgaactcgccgccggccggctcgccgaccgcgatctcgtccaggccgtgtcgctcctggcgtggatgggggagtcccggggggccggcgaggcggtactgcgactgcagcggaccgacagcgaggccgaggcggccggacgggcgcccgcctacgacccgggcacgctcaccgccgcacagagctggctctcgatggtcagcccgccggcccgcgacctcttcgacgccgtggaaccgcgccggacaacgctgtcaggcgcgccgggggcgctgcccggcgcggggcccgacaccgtcccctacgacatgcccgacaacgcctacgtccaggccgccgacgccgtccgcaccgccctgcgcggcggaacccaggccgacgccgccgtcagcaaggccacccgggtgctccagcgctaccacctgagcgaccgcaccctccagccgctcgtcttcgccctcctcgccgtcatctacgcgggtcgcctcgacctcgcgtccgcctggtgcgaacgactgctcggcgagtgctccgcccgcaacgccccgacctggcaggccgccctcggtgtggtccgggccgagatcctgctgcgccagggcgatctgcccggtgcggccgcccaggcccgccacgccatgtcccggatctccctgcagagctggggcgtgggcatcgcgctgccgctggccgtcctcgtcgaggccgaggtccagatgggcgaccacgaggaggcgatgagcctgctcgaacagccggtgccccaggccatgttcgacaccctggccggcctgcactacctcagggcccgcggccgctgccacctggccaccggccgctaccacgccgccgtgcgggacttcctgaactgcggcgagctgatgcaggcctggggcgtggacggggcggagctggtgccgtggcggctggacgccgccgaggcgtggctggccctcggcaacgtcgcgcgcgccaaggagtacaccgagcagcagaagcagcgcgagacggggcccgtgggcagccggacgcgtggctccctgctgctcacgctcgcccacaccggcggtgacctcacggtccggctcaagcggctcgtcgaggccgtcgagaccctggaggagggcggggaccggctccagctggcggtggcgctgggggagctgggccgcggctaccgtgcgctgggcgacttcaaccgggcccggatgctggtgcgcaaggcctggcacgtcgccaagtcctgcggcgccgaaccgctgtgccagcagttcatgccggggcaggtcgacggcgaggccggtgcgcagagcggccgggaggcggagcttcccagcgaggtcgaggtcctgtccgaggccgaggcgcgggtcgcgctgctggcggcgcgcggccacaccaaccgtgagatagcgaccaagctctacgtcacggtgtccacggtcgagcagcatctgacgcgcatctaccgcaagctgaaggtgaagcggcgccgcgatctgcccgcccggctgtcggacctgagcctgccgagcatcgcctga

SEQ ID NO: 8 - protein, 201 aa, Streptomyces aizunensis
MLVDDHPVVREGLSSMLQSADGVSVVGQADSGEEAIAMVTRLAPDIVLLDLQMGGMDGVETTGHLLRVAPATKVVIVTTYESDTDILRAVEAGAAGYLLKGSSRDELVQAVKAAARGETVLTPSLAPKLFRARVVEPPALSDREREVLQLVSLGLTNADIGRQLFISEATVKTHLLRSFKKLSVSDRTAAVITALKLGLLS

SEQ ID NO: 9 - DNA, 606 bp, Streptomyces aizunensis
atgctggtcgacgaccacccggtcgtacgggagggtctcagctcgatgctgcaatccgccgacggcgtgagcgtcgtcgggcaggccgactcgggcgaggaggcgatcgcgatggtcaccagacttgctcccgacatcgtcctgctcgaccttcagatgggcgggatggacggggtggagaccaccggccacctgctgcgcgtcgcgccggccaccaaggtggtgatcgtgacgacgtacgagagcgacacggacatcctgcgggccgtggaggcgggcgcggcgggctacctgctcaagggcagctcgcgcgacgaactggtgcaggcggtaaaggcggcggcccgcggtgagacggtcctgacgccgtcgctcgcccccaagctgttccgggcccgggtggtggagccgcccgcgctgtcggaccgtgagcgcgaggtgctccagttggtcagcctcgggctgaccaacgcggacatcggccgccagctgttcatcagcgaggcgacggtgaagacgcatctgctgcgctcgttcaagaagctgtcggtctcggaccggacggccgcggtgatcacggcactgaagctcggcctgctgtcctga

SEQ ID NO: 10 - protein, 416 aa, Streptomyces aizunensis
VSTESPAAQATDGQDDAPEAGARWFGLWDALFAVSYAVTTMLLFTSDGEQVHRAVAMAALTAAVPWYAALGRSTMVHEGQGPVRRSVVFSVGLFVLFAVAVVFDLAASFALFAVVPMLMMSLATSPAIAVVTLANLVPVIVVWLRGGTLSRDILAVLPTSLLGIALSVMLGLWITRVTRQSRDRAELIEELHRNRAQVARLSRKAGVSAERERLAREIHDTLAQGLTSIISLVQAAETDFTADPDRARAHLALAGRVARESLGEAREFVTELTPPALQESSLVQATRRQAEGLTAQTGMRAHVTVEGDERELPMAISVVLLRSLQEAIANIRKHAGKARAAEIRLVYEQDTVRLLVRDDGPGFTVTGDQRGSGLRGMQTRAHEISGAATVVSSPGQGTTIEVTVPVPAKGEEADER

SEQ ID NO: 11 - DNA, 1251 bp, Streptomyces aizunensis
gtgagcactgaatcccccgcggcgcaggcgacagacggccaggacgacgcgcccgaggcgggagcccggtggttcggcctgtgggacgcgctcttcgcggtctcgtacgccgtcaccaccatgctgctgttcacctccgacggtgaacaggtccaccgggccgtggccatggccgcgctgaccgcggccgtgccctggtacgcggccctggggcgcagcaccatggtccacgagggccaggggcccgtccggcgcagcgtcgtcttctccgtcggcctgttcgtgctgttcgcggtggccgtggtcttcgacctcgcggcctcgttcgcgctgttcgccgtggtcccgatgctgatgatgagcctggcgacctcgccggccatcgccgtggtcacgctggccaatctggttccggtcatcgtggtgtggctgcgcggcggcaccctgagccgcgacatcctggccgtcctgccgacctcgctcctcggcatcgccctgtcggtcatgctcgggctgtggatcacccgggtgacccggcagagccgtgaccgggccgagctcatcgaggagttgcaccgcaaccgtgcgcaagtcgcccggctgtcgcgcaaggcgggggtctccgccgagcgcgagcggctcgcccgggagatccacgacaccctcgcccagggcctcaccagcatcatcagcctcgtacaggccgccgagaccgacttcacggccgacccggaccgggcgagggcgcatctggcactggcgggccgcgtggcccgcgaaagcctgggagaagcccgcgagttcgtcaccgagctgaccccgcccgcgctgcaggagtcctcgctcgtgcaggcgacgcggcggcaggccgagggcctgacggcgcagaccggcatgcgggcgcacgtcaccgtcgaaggagacgagcgggaactgccgatggcgatcagcgtggtcctgctgcgttccctccaggaggccatcgcgaacatccgcaagcacgcggggaaggcacgcgcggccgagatccggctcgtgtacgaacaggacaccgtacggctgctcgtacgggacgacggacccgggttcaccgtcaccggggaccagcggggaagcgggctgcgcggcatgcagactcgcgcacacgagatcagcggggcggcgaccgtggtcagcagccccggacagggcaccaccatcgaagtgacggtgcccgtgcccgcgaagggagaggaagccgatgagcgctga

SEQ ID NO: 12 - protein, 186 aa, Streptomyces aizunensis
LSPFLNTLIASGTILAVILSTDLGTRKVTTTRMLPSLLAVVVILALLVHTLPLDGNDPSLQLAGIGAGIICGLAATALLPAHRNASGEVSTKGGIGYALVWTALSASRVLFAYGSQHWFSEGIVRFSTDYKLSGQAVYSNAFAFMALAMVLTRTAVLLNTRRRLRGGQLPAADNTAPHQASSANTH

SEQ ID NO: 13 - DNA, 561 bp, Streptomyces aizunensis
ctgagcccgttcttgaacacactgatcgccagcgggacgatcttggccgtcattctgtcgaccgacctcggcacccgcaaagtcaccacgacgcggatgcttccttcgctcctcgcggtcgtcgtgatcctcgcgctcctcgtgcacacactgccgctcgacggcaacgacccctcgctccaactggcgggcatcggcgccggtatcatctgcggactggccgccacggcgctcctccccgcccaccggaacgcttccggtgaggtctccaccaagggcggtatcggttacgcgctggtgtggaccgcgctgtccgcctcgcgtgtgctcttcgcctacggttcacagcactggttcagcgagggcatcgtccggttcagcaccgactacaagctcagcggacaggccgtctactccaacgctttcgccttcatggccctggccatggtgctgacgcggaccgccgtcctgttgaacacgcgccgccggctgcgcggcgggcagcttcccgcggccgacaacacggccccacatcaggcgagttccgccaatacgcactga

SEQ ID NO: 14 - protein, 163 aa, Streptomyces aizunensis
MHDVRLRPPRNRVDSRAVGWWTVQSAMYALPLPITFGVLYLCIPPARPFFGWAFLISLVPGLAYMAVMPAWRYRVHRWETTDEAVYAASGWLWQQWRVVPMSRIQTVDTLRGPLQQLFGLSGITVTTASYSGAVKIKGIDHRTARDVVEHLTRVTQATPGDAT

SEQ ID NO: 15 - DNA, 492 bp, Streptomyces aizunensis
atgcatgatgtcaggctccggcccccgcgcaatcgtgtcgactcccgggcagtgggctggtggacggtccagtccgcgatgtacgccctgcccctgccgatcaccttcggcgtgctgtacctgtgcatcccgcccgccaggccgttcttcggctgggccttcctgatctcgctcgtaccgggcctcgcctacatggccgtcatgcccgcctggcgctaccgggtgcaccgttgggagaccaccgacgaagccgtctacgcggcgtccggctggctctggcagcagtggcgggtcgtgccgatgtcccgcatccagacggtggacaccctgcgcggacccctccagcagctcttcggcctctccggcatcaccgtcaccaccgcctcctactccggcgccgtgaagatcaagggaatcgaccaccggaccgcgcgggacgtggtcgagcacctcaccagggtgacccaggccacccccggagacgcgacatga

SEQ ID NO: 16 - protein, 514 aa, Streptomyces aizunensis
MSHDTGQWEATATSHGAAEDPEWSRLSPRLLLVNLSMLAGPLALFAVTVALTGANLQALISLGSLLIVFLVITGISTMRLLTTRFRVTAERVELRSGLLFRSRRSVPIDRVRSVDVEAKPVHRLFGLASLRIGTGEQGASSRRLSLDGITRRQARRLRRLLIDRRGSGHATGQDQDVTIAEMDWAWLRYAPLTIWGVGSVFAAVGTAYRILHEMKVDPLELGVVKDIEDRFGSVPLWFGILVAVVITAVVGAAVSTATFVDAWTNYRLEREGVGIFRIRRGLLISRSVTIEERRLRGVELAEPMLLRWAGGATLSAIASGLSNSQENRSRCSLTPPVPRDEALRVAADVLAEEGSPTELTKLVRHSRAALRRRINRGLLVLAAVVAVPLGLGLWLTPVLVHTAWITALVGLPVVIVLANDAYRSLGHGIRDRYLVVRAGTFARRTVAVQRDGVIGWNISRSYFQRRSGLLTIGATTAGVGCHKVRDVSVGAGLAFAEEAVPRLLAPFIERVPRG

SEQ ID NO: 17 - DNA, 1545 bp, Streptomyces aizunensis
atgagccacgacaccggacagtgggaggccaccgcgacctcccacggcgccgccgaagaccccgagtggagcaggctcagcccccgactgctgctggtcaacctgagcatgctcgccggcccgctcgccctgttcgccgtcacggtcgccctgaccggcgccaacctccaggccctcatctccctcggctccctgctgatcgtcttcctggtcatcaccgggatcagcacgatgcggctgctgaccacccgcttccgcgtcaccgccgaacgcgtcgaactgcgctcgggcctgctcttccgcagccgccgctcggtccccatcgaccgggtccgcagcgtcgacgtcgaagccaagccggtgcaccgcctcttcggcctcgcctcgctgcgcatcggcaccggtgaacagggcgcgtccagccgcaggctctccctcgacggcatcaccaggcgtcaggcgcggcgactgcgcaggctcctcatcgaccgccgtggcagcggccatgccaccggccaggaccaggacgtcaccatcgccgagatggactgggcctggctgcggtacgcgccgctcaccatctggggcgtcggcagcgtcttcgccgccgtcggcaccgcctaccgcatcctgcacgagatgaaggtcgacccgctcgaactgggcgtcgtcaaggacatcgaggaccgcttcggttccgtacccctgtggttcggcatcctcgtcgccgtcgtgatcaccgccgtcgtgggcgccgcggtctccaccgccaccttcgtggacgcctggaccaactaccgcctggagcgtgagggggtcggcatcttccggatccgccgcggactgctcatttcccgctccgtcaccatcgaggagcgccggctgcgcggcgtcgagctcgccgagccgatgctgctgcgctgggcgggcggcgccaccctgagcgccatcgccagcggcctcagcaacagccaggagaaccgcagccgctgttccctcaccccgcccgtgccccgggacgaggcgctgcgggtcgccgccgacgtcctcgccgaggaagggtccccgacggagctgaccaagctcgtccggcactcccgtgccgccctgcgccgtcgcatcaaccgcggcctgctggtcctcgcggccgtcgtcgcggtgccgctgggcctggggctgtggctcacccccgtcctggtgcacaccgcctggatcacggcgctcgtcggcctgccggtcgtcatcgtcctcgccaacgacgcctaccgctccctcggccacggaatccgcgaccgctacctcgtcgtccgcgccggcaccttcgcccgccgtacggtcgccgtccagcgggacggcgtcatcggctggaacatctcccgctcctacttccagcggcgcagcggactgctcaccatcggcgccaccaccgcgggcgtcggctgccacaaggtgcgcgacgtatccgtcggcgccggcctcgccttcgccgaagaggccgtacccaggctgctcgccccgttcatcgaacgcgtcccgcgcggctga

SEQ ID NO: 18 - DNA, 164051 bp, Streptomyces aizunensis
ctggctcagcccgccagctcctccagcctcggcaccagcgacaccggagagggcatcgtccggatctccgcgcgcacctcgcgcgcggccgccgtcatcttctcgtccgaaagcagctgtacgaggacctccgcggagaggtcgtcggcggtgccgagcagaccggcaccccggtcccgtacggcctccgcattgatgtgacggtccgctccgtccggcaggacgagctgcggcacaccggcgttcagcgccgccagcgtcgtccccgcaccaccgtggtgcacggccgcgtcgcaggtctgcagcagcgccgtcagcggcacccaccccacggcccggacgttgggaggcagttcaccgagcgccgtggtgtccacatcgcccagcgccagcacgaactcggcgtccaccccggcagccgccgccgcgagccgctgcaccgggcccaggccgttgatgtggaccgaggccgtgccgagcgtcaccccgacccggcggcgccccggcttctccagcagccagtccggcagcaccgcaccgctgttgtacgggaccggccgcatcgaccagccgtcccgctcgggctccgccatgctcggcggcgcgatgtcgatcaccgggacccgttcggacacccggtccacgccgtgccgcgccatcgtctcggtgagcatcgacaccgtcagctcgcgcagctgcgtaccccgcgcgaaaccgaagttgtgctgcacggccggcacacccagccgcgccgccgcgatcagaccggacacgaagatctgctcgaagacgatcagatcgggccggaaatcgtcggcggtccgcacgatgccgtccgccaggtggttgttgaggtgggcgaagagggtcagcccgtccatcgggtcgacgccgcccggaccgcgcaggcgggccatcagctcaccggccgtcgactggaggaagtcctccaggtggaagccgggggcgacatccgccacgtgcagaccggcgttggcggcctccagcgcgtcacccgcgctggcgaccagcacctcgtggccggccgagcgcaacgcccaggccagcggaacaatgggaaaaacgtggccgatggccggatacgtcacgaacagtatgcgcaaggaaacgcgcccccttgggtagctttgtattctccggaccggtatggtccagatggaatacggtggatattctttaaatccccgacggtgcctgggcatcctgatgcagtcgcacatgccgagtcaaggcggcgtccgaaggcccgtgttaggggtccgtaggggcctgttaggggtttctcccacttccctcgcatgcaagagtgtcccctggtcttggattctttattcgggggtaatggagcgcgcgatgttgaatgagtccgaggaattcacgcccgaaatcaatgtcgcctccgaagtcggtggaacgcagggcgaaagtcctgaaagcacgccgtcgtggcagcagcgcctgaccggcctcaccgaggccgagcagcacaccgcactgctggagtgggtgtcctcgctggcatccgccgcactgcgcgacgcggcccccgacacgctcgacccccaccgccccttcctggatctgggcttcgactcgctcgccgccgtcgacctgcacgccaggctcgtcgcgggaaccgggctgcggctgccggtcaccctggccttcgaccaccccacccccgcgcacctcgcccgtcatctgcacgcggcgatcctcggactgaccggccccgccgagacgcccgtcaccgcggcggtcggcagcgacgaacccatcgccatcgtcggcatcggctgccatttcccgggcggcgtacagtcccccgaggcgctgtggaacctcgtcgagaccggcaccgacgccatttccgcattccccaccgggcgcggctgggatctcgacgcgctgtatgacccggatcccgaccgggcgggcaccagttatgcccgcgagggcggattcctgcacgacgccgacgcattcgacgcggcattcttcgggatatccccgcgcgaagccctcgccatggatccgcagcagcgactccttctcgaagcgtcctgggaggcattcgaccgcgccggggtagaccccgccgcattgcgcggcggtcaggtcggcgtattcgtcggcgccgagacccaggaatacggcccccggctccaggacgccaccgacggattcgagggctacctcgtcaccggaaacgcggccagcgtcgcctccggccgtatcgcctacaccttcggcttcgagggcccgacggtcaccgtcgacacggcctgctcctcctcactcgccgccctccacctcgccgtccaggcgctgcgcaccggcgaatgctccctcgcgctcgccggtggcgtcgcggtcatggcgagccccggctcgttcgtctcgttcagccgccagcgcggcctggcccccgacggccgctgcaagccgttcgcggccgccgccgacggcacggcgtggggcgagggcgtcggcatgctgctggtcgaacggctctccgacgcgcgcgccaagggccaccggatcctcgcggtcgtccgcggctccgccatcaaccaggacggcgccagcaacggcctcaccgcccccagcggtccgtcccagcagcgcgtcatccgccaggccctcgccaacgccggcctgtccgccgccgaggtcgacgtcgtcgaggcgcacggcaccggcacccggctcggcgacccgatcgaggcccaggcgctcctcgccacgtacggccaggagcacaccgatgaccggccgctgtggctcggctccctgaagtcgaacatcggccacacgcaggccgccgccggagtcgccggcatcatcaagatgatcatggcgatgcggcacggggtactgccccggaccctgcacgtcgacgcgccgaccccgcacgtcgactgggaggccggagcggtcaccttgctgaccgaagccgtggagtggccggagtcggaccgcccgcgccgtgcgggcgtgtcctccttcggcatgagcggcaccaacgcccacgtcatcgtcgaagagccggccgcccaggaccgcgagggcgcccccacctccggcgcccaagcccccgactccagccagggccaggcacagggcacctccaccgcgccggttctcctcccgtgggcgctctccgccaagacccccgaggccctccgcgcccaggcacgccgactcggcaccctgatcgcggcgcagccgcacgtcacccccctcgacatcggccactccctcgcgaccacccggggccgcttcgagcagcgcgccatcgtgctcggcgacgaccgcgaggcgttcctcgacgccctgcacgccctcgccgagggcaacgacacgccctccgtggtccagggcgccgccgcaccgggcaagctcgccttcctcttcaccggccagggcagccagcgcctcggcatgggccgcgaactgtacgagacccacccggtgttcgccgacgccctcgacgacgcctgctggtacctggacgaccaactcgaactcccgctcctcgacgtgctgttcgccgacgagggcagccccgaggccgcacttctgcaccagaccgcctacacgcagcccgcgctgttcgcggtcgaggtggcgctgttccgcctggtcgacagctggggcctgaagcccgacttcgtcgcgggccactccatcggcgagatcgcggccgcacacgtggccggagtgttctccctggaggacgcctgcatgctcgtcgccgcacgcggccgcctcatgcaggcgctgccggccggtggcgtgatgatcgcgctgcaagcgtccgaggacgaggtgctgccgctgctcaccgaccgggtgagcatcgccgcgatcaacggcccgcaggccgtggtcatcgccggtgacgaagacgcggcggccgcgatcgccgagaccttccaggccgcgggccgcaagaccaagcggctgacggtcagccacgcgttccactcgccccacatggacgccatgctggaggaattcctccgcgtcgcccaggtgctggactacgccaagcccaccctccccgtcgtctccctcctcaccggcaccaccgcgacccccgccgaactggccacccccgcatactgggtgcgccacgtccgggacgccgtccgttacctcgacggcgtacgcaccctccaccagcggggcgtacgcaccttcctggaactcgggccggacgcggtgctcaccgccatggcacaggactgcgtcgacccgcagggcgccgccttcgcccccgcgctgcgctccggccgcccggaggcggccactgtgctcaacgccgtcgcgcacgcccacgtccggggtgcggagacggactgggccgcgttcttcgccggtacgggcgctcagcgggtcgatctgccgacgtacgccttccagcggcagcgctactggatggactcccgcaccccggccccggactccgccgcgcagcgggcgcacggcggcgccgatccggtcgaccgtgtgttctgggacgccgtcgagcacgaggacgtggccacgctcgccgccgccctcgaactcgacctcgacggcgaacagccgctcagcgaggtcgttccggcactgtccgcctggcgtcgccgccgccgcacccagtcggaggtggacggctggcgttaccgggtgacgtggaagccgctgactgaggtctcgacgtctgggttgtccggttcctgggtggtgatctcgccagctgggggtgccgatgactcggctgtggtgagtgcgctggttgggcgtggtgttgacgtccgtcgggttgtggtcgaggcgggtgtggaccgttcggcgctggctgggttgctggctgaggttggttcgccttcgggtgtggtgtcgcttctcgggctggatgagtccggggggttgttggggactgttggtttggtgcaggcgttgggtgatgccggggtgggggcgccgttgtggtgcctgactcgtggtgcggtgtctgtggggcgttcggatcggcttgtgtcgccggttcaggcgcaggtgtggggtttggggcgggttgctgctctggaggttccggagtggtggggcgggctcatcgatctgcctgaggtgctggacgagcgggctgtgtcccgcttggtcggtgtacttgcgggttccggtgaggatcaggtcgcggttcgttcgtctggtgtgttcggtcgtcgtctggtgcgtgcaccgcgggccgagggtgcttcggcgtggtctccgaccggcacggttctcgtcaccggtggtacgggtgtgctgggtggccgggtggcgcgttggctggcgggggcgggtgctgagcgtctggtgctgaccagccgtcgtgggctggatgcgccgggtgcggttgagctggtggaagagctgaccaccggctttggggtggaggtttcggtcgtcgcgtgtgatgcggccgaccgtgacgccctgcgtgccctgctgtccgctgaggccgggtctctgaccgctgtggtgcacacggccggtgttctggacgacggcgtcctggatgctctgaccccggaccgtatcgacagcgtcgtgcgtgcgaaagccgtctcggctctcaacctgcatgagctgacggccgagctgggtatcgagctgtccgacttcgtcctcttctcctccgtcacaggtacggtcggcgcggccggacaggccaactacgccgctgcgaatgccttcttggatgctctggccgagcagcggcgcgccgatggtctcgcggcgacgtccatcgcgtggggtccgtgggccgagggaggcatggccgccgacgaggcgatggacgcacggatgcgccgcgagggcatgcccccgatggcgcccacatccgcgatgagcgcactggagcaggccgttggtgcgggcgagacggcgctgaccgttgccgacatcgactgggagcgtttctcctccgtcatcgccgcagtccgccccaacccgctgatcggtgacttcgtcgtcggagcggaaggcacggccgccgccagcggccacggatccgtggtcaccggcgccgatgtcgccgccaccgtctcgggccggttggcgggcctgacccaggccgagcaggagcgggaactgctcagcctggtccgtctgcacgtggccgcggtactcgggcacgacggatcggacgcggtcggtgccgaacgggccttcaaggaactcggcttcgactccctgacctccgtcgagctgcgcaaccgcctcggagccgccaccgatctccggctccccaccacgctcgtctacgactaccccacgtccgccgctctcgccgagtacctgcggggcgaactggccggcagcgcgcaggacgccgggccgcccctgcccgccgtggtcggctccgccgccgacgacgatccgatcgtgatcgtctcgatgagctgccgcttccccggtggcgtacggactccggaagacctgtggcagctcctcgcggacggcacggacacggtcgccgccttcccggccgaccgcggctgggacctggacggcctctacagcgccgacccggagcgttcggggacctcgtacacgcgtgaaggcgggttcctctacgacgccgccgacttcgacgcggacttcttcgggatctcgccgcgcgaggccctcgccatggacccgcagcagcgcctgctgctcgaaaccgcctgggagaccttcgagcgcgccgggatcgacccggcgtcgctgcggggcagccaggccggtgtcttcgtcggcaccaacggccaggactacctctcgctggtcacgcgcgaaggcgacggactcgacggactcgaaggacatgtcggcaccggcaatgcggccagtgtcgtctccggccggctctcttacgtcttcggtctcgaaggcccggcgatcacggtcgacacggcctgctcgtcgtcgttggtcgccctgcacctggccgtgcaggcgctgcgccagggcgagtgcaccttggcgctcgccggtggtgtgacggtgatgtccactccggacgccttcgtcgacttcagccgtcagcgtgggctcgcggaggacggccgtatcaaggcgttcgcgtcggccgcggacggtacgggctggggtgagggcgtcggcatgctcctggtggagcggctgtccgacgcccgtaggaacggtcacccggtcctggcggtcgtgcggggctcggcgatcaaccaggacggcgcgagcaacggcctgaccgcgccgaacggtccgtcccagcagcgcgtcatccgccaggcgctggccggtgcggggctgtcggccgccgacgtggacgcggtggaggcgcacggtacgggcacccggctcggtgacccgatcgaggcgcaggcgctgctcgccacgtacggccaaggccgcccggcggaccggccgttgtggctgggctccgtgaagtcgaacatcggtcacacgcaggccgccgcgggcgtggcgggcgtgatgaagatggtcatggcgatgcggcacggtgtgctcccgcgcacgctgcacgtggacgggccgaccccgcacgtcgactggtcggcgggcgacgtcgccctgctgaccgagcagcgggagtggccggcgaccggccacccgcggcgggcaggtgtgtcctcgttcggcctgagcggtacgaacgcccacaccatcatcgaagaagccccggccgacgacgacgccgagcccacgaccggcgcggggacggccccgtccgttctgccgctgctcatctctgccaagagcgacgccggcctgcgcgcacagtcggagcagctggcgacccatctggtcggaaacccggacgtccccatcggggacatcgcctactccctcacgaccggacgctccgggctggagacgcgagcgatcctggtcggcgacgccgacaaccgcacagggctcgcggccgcgctgcgaagcctcgctgccggcgagcaggctccgggcctggtccagggcacggtgaccgagggcgggctggcgttcctgttcacggggcaggggagccagcggctggggatgggccgtgagctgtacgagacgtatccggtgttcgcggatgcgctcgacgcggtgtgcgcgcggatggatctcgaagtcccgctgagggacgtgctgttcggggcgtatgcgggtctgctggatgagaccgcgtatacgcagcctgcgttgttcgcggttgaggtggcgttgttccggctggtggagagctggggtctgaggccggacttcgtggcgggtcattcgattggtgagatcgctgctgcgcatgtggcgggggttctgtccctggatgacgcctgtgctctggtggaggcgcgtgggcggttgatgggtgcgctgcctggtggtggcgtgatgatcgcggtccaggcgcctgaggctgaagtcctgccgctgctgaccgagcgcgtgagcattgccgcgatcaatggtccgcagtcggtcgtgatcgcgggtgacgaggccgacgcggtggcgatcgtggagtcgttcacggggcgtaagtccaagcggctcacggtcagccacgcgttccattcgccgcacatggacggcatgttggaggacttccgggccgtggcggaagggctgtcgtacgaggccccgcgcatccctgtggtttccaacctcaccggggccctggtctcggatgagatggggtcggctgagttctgggtgcgtcatgtccgcgaggcggttcgcttcctggacgggatgcgtgttctggaggccgccggggttacgacgtacgtcgagcttggcccggggggtgtgctgtcggcgctggcgcaggagtgtgtcagtggggacggtgctgctttcgtgccggtgctgcgttctggccgtcccgaggccgagaccgcggtcaccgcgttggcccaggcacatgtgcggggtgtggacgtcgactgggccgcgttcttctccgggaccggcgtccagcgggtcgacctgcccacctacgccttccagaggcagcggttctggcccgcgatgacggcggagagtgcgccggtcggcgggacggtcgacgcggtggacgcccacttctgggatgtcatcgagcaggaggacgtcgagtcccttgctgagttgctcggtctcgacgacgcgagcgcgtgggggagtgtggtccccgcgctctcggcctggcgtcggcagggccaacagcaggcccaggtcgacggatggcgctaccgggcgagctggaagccggtgacggctgcggtgtcgtccggcgtggtgagcgggacatgggttgtcgccgtacctgccggatctgcgggggacgacgcgcgggtcgaggccgtgaccaacgggctggctgggcgtggcgttgacgtccgtcgggttgtggtcgaggcgggtgtggaccgggccgcgctggctgggttgctggctggtgagggatctctcgctggtgtggtgtcgcttctcgggctggatgagtccggggggctggcggctactgctggtttggtgcaggcgttgggtgatgccggggtgtcggcgccgttgtggtgcctgacccgcggggctgtttccgtcggtcgttcggatcggcttgtgtcgccggttcaggcgcaggtgtggggtctggggcgggttgctgctctggaggttcccgagcgttggggcgggctggttgaccttccggaagtgctggatgagcgggctgtgtcccgcttgatcggtgtacttgcgggttccggtgaggatcaggttgcggttcgttcgtctggtgtcttcggtcgtcgtctggtgcgtgcaccgcgggccgagggtgctgcgtcgtggactccgaccggcacggttctcgtcaccggtggcacgggtgtgctgggtggccgggtggcgcgttggctggcgggggcgggtgctgagcgtctggtgctgaccagccgtcgtgggctggatgcgccgggtacggctgaactggtcgaggagctgaccagctccggggtggaggtgtcggtcgtcgcgtgtgacgcggccgaccgtgacgccctgcgcgccctgctctcctctgaggccgggtctctgaccgctgtgatccacacggccggtgtcctggacgacggtgtcctggatgctctgacgccggaccgtatcgatggtgtcgtgcgtgcgaaggccgtctcggctctcaacctgcacgaactgacggccgagctgggcatcgagctgtccgccttcgtcctgttctcgtccatgagcggcacggtgggcacggcgggtcaggccaactacgcggctgccaatgcctacctggatgctctggccgagcagcgccgggcggacggtctcgcggcgacgtccatcgcttggggtccgtgggcggagggtggcatggccgccgatgcggcgctcgaagcccgtatgcgccgagacggggtgcctccgatgcccgcggatccggcgatccgcgctctccggcaggccgttgcaggcgacgacgccgtgcttaccgttgccgatgtcgaatgggaccggttcctcccgggcttcgtcgccgcacggcacagcgagctgttcagcgagctgcgtgacgtccgtgatgcccgcgcggcacaggatcgggcgcaggccgccgttgccgccgaccgtccggactccctttccgggcggctgtccgcccaggcgccggccgagcaggagcgagagctgctggacctggtccgtacgcaggtcgccgccgtgctcgggcacgccggagtggaaaacgtgggcgcggggcgggcgttcaaggagcttggcttcgactcgctcatggccgtcgagctgcgcaaccgcatcggctcggccaccgagcttcggctcccggccaccttgatctacgaccaccccacgtccgccgccctcgcggagttcctgcggggtgagctggtcggcaccgtgcgggtcgccgacaaggtgctgcccgccgtggtctccgccgacgaggatccgatcgcgatcgtctcgatgagctgccgcttccccggtggcgtacggactccggaagacctgtggcggctcctcgtggacggcacggacgccgtcggcgcgttcccggccgaccgcggctgggacctggacaggctctacagccccgacccggaccagccgggcacctcgtacacccgcgaaggcgggttcttcgacggggccgcggacttcgatcccgggttcttcgggatctcgccgcgcgaggcgctcgccatggacccgcagcagcgactgctgctcgaaacctcctgggaggcgatcgagcgggcgggcatcgacccgtcgtcgctgcgcggcagccaggccggtgtcttcgtcggcaccaacggccaggactacctctccctcatcacccgtgaatcggagggcctggaaggtcacttgggcacgggtaacgcgggcagcgtcatgtccggccgcgtctcctacgtgctcggcctggagggtccggcggtcacggtcgacacggcgtgctcgtcctcgctggtcgccctgcactgggcgatccaggccctgcgtcagggcgagtgcagcatggctctggccggcggcgtgaccgtcatgtcgacgcccgagaacttcgtcgacttcagccgtcagcgcgggctcgcggaggacgggcgcatcaaggcgttcgcgtcggccgcggacggtacgggctggggtgagggtgtcggcatgctcctggtggagcggctgtcggatgcccggcgcaacgggcatccggttctggcggtagtacgtggttcggctgtcaatcaggacggtgcgagcaatggtctgacggctccgaatggtccttcgcagcagcgggtgatccgtgcggcgctggcgagtgcaggtctgtcggccgctgatgtggatgtggtggaggcgcacggtacggggacgaagctgggtgacccgatcgaggcgcaggcgctgctggcgacgtacgggcaggaccggcccgcgggccgtccgctgtggctgggttccatcaagtcgaacatcggtcatacgcaggccgccgccggtgtcgcgggcatcatcaagatggtcctcgccatgcagcacggcgtgctgccgcagacgctgcacgtcgacgagccgaccccgcacgtcgactggtcggcgggcgaggtcaccctgctgaccgagcagacggcctggccgacggtggaccggccgaggcgagcgggagtgtcgtccttcggcatcagcggcaccaacgcccacaccatcatcgaacaggccccggcggtcgagcagttggcggacggtgacgcgactcccgccactccggccctcgcgctcccgctgccgtacgtcctctccgcgaagagccccgaggccctgcgcgcccaggcgtccgtactgcgcacgcacctggaggccacggaccacaacgggcccggttccgacgacctggccttctcgctcgccacggcacgtgcgcacctcgaacaccgcgcagtcctgaccgccgacgacccacaggaattccgggaggcactcgcacgcctcgccgacggtgatccctcaccgaggatcaccaccggggcggtgagcgacggtcgtacggcgttcctgttcacgggccaggggagtcagcggctcgggatgggccgtgagctgtacgaggcgtatccggtgttcgcggacgcgcttgacgcggtctgcgcgcatgtggacgcgcacctcgaagtgcccctgaaggacgtcctgttcggggcggatgcgggtctgctggaccagacggcttacacgcagcccgcgttgttcgcggtcgaggtggcgttgttccggctggtggagagctggggtgtgaagccggacttcgtggccggtcattcgatcggtgagatcgcggccgcgcatgtggcgggcgtcttctcgctccaggacgccagtgaactggtcttcgctcgtgggcggttgatgcaggcgctgccgaccggtggcgtgatgatcgcggtccaggcgtcggaggacgaggtcctgccgctgctgaccgaccgggtgagcattgccgcgatcaacggcccccagtcggtcgtcatcgcgggcgacgaggccgacgcggtggccatcgccgagtccttcacggaccgcaagtccaagcgcctcacggtgagccacgcgttccactcgccgcacatggacggcatgctcgacgccttccgtgagatcgccgagggcctctcctacgaaccttcgcgcatcccggtcgtctcgaacctcaccggcgctctcgtctccgatgagatgggctcggccgagttctgggtgcggcacgtccgcgaggccgtccgtttcctcgatggcatccgcacgctggaagccgcgggcgtcaccaagtacgtcgaactcggccccgacggcgtgctgtcggcgatggcccaggactgcgtgagtggcgagggctccgtcttcatccccgtgctccgcaaggcgcgccccgaggccgagagcgtcacgaccgccctcgcctcggcccacgtccacggcatccccgtcgactggcaggcgtacttcgccgggaccggcgcccagcgcgtcgacctccccacctacgccttccagcgccagcgctactggcccagcgctgccgcgttcgtcaccggcgatccgacggcgatcgggctcggggatgccgggcacccgttgctgggtgcggcggtggcgctcgccgactccgagggcgtgctcttcaccggccgcctgtcgctcgacacccacccctggctcgccgaccacaccatcctcggcagcgtcctgctgccgggcacggccttcgtcgacctggcgatccgggccggcgatcaggtcggatgcgatgtggtcgaggagctgaccctcgaagcgcccctcgtcgtcccccagcggggcggtgtgcagctccagctcgtcgtcgaggcgccgagcgggcccgggcagcggccgttcagcgtgcactcccggcggcaggacgcctacgcggaggagccgtggatgcggcacgcctccggagtgctgacttccggcgtttcccgccgcgaactgtccgtggaaggcggggagttcgaggcgctggccgtctggccgccgaccggagccgtacccgtggacgtacgaggtctgtacgaggagctcgccgaggccggtgtggcctacgggccgctgttccaggggctcaaggcggcgtggcggcgggacggtgaactgttcaccgaggtggcgctcccgggtgaagcccggcgtgaggcggcacggttcggtctgcacccggctctgctggacgccggtctgcacgccatcggccacggcgagggaccggaaccggcaatgaccggcgcgctgttgcccttctcctgggcaggagtctcgctgtacgcggcgggcgcctcctcactcaggatgcggctgaccccgcacacacccgacgacgcccacaccatggcgttgctcgtggcggatgagaccggacgtccggtggcggccgtggagtcgctgatcctgcgtaccgcgtcggccgaccaggtgcgcgcggccgacggaggtcacctcgactccctcttcaaggtggagtggctgcccgtggcgggcggagccacgccgcacggcgactccaccggacggcgatgggccgtcctgggccgcgacggactcggcctgccggccaccggcgtgcaggggcaggtggccgagtacgacgatgcctccgcgctcggtgcggcgctcgcggccggcgaaccggtgccggacgccgtgttcgtccaccctggggctcttccggggcaggacacggacaccacggcggcctccgtacacgccgccgtgacggacgcgctgtccttcgtacaggaatggctggcggacgagcggttcgccgccacgcgcctggtgtggctgacatccggcgcggtggcggacgagcccggcgcgggcgtccgggacctggcgggcagcgccgtacgcggcctgctgcgctcggcgcagtccgagaaccccggccagctgctgatgctcgacctcgaccaggacccggcctcgctcgcggcgctgcccgccgcgctggccgcgggtgagccggaactggcgatacgacgcggagaactccgtaccccgcgcctgacgcgcgtcccctcggcggacgccgcggcagagccgctcggcacactcggcgacccgtccggcacggtactcgtgaccggagccaccggaaccctgggcggactcttcgcccgccatctggtgacggcgtacggggtgcggcgactgctgctcaccagccgtcgcggccccgaggccgaaggtgcggccgaactggtcgccgaactggagcagttgggggcgcacgtcgaactcgtcgcctgcgacgccgccgaccgctccgcgctcgccgcgctcctcggagccgtaccgtccgagcacccgctgacggccgtggtgcacacggcaggcgtactggacgacggcatcctctcctcgctcacccccgagcgcgtggccgccgtactgcgtccgaaggtggacgccgcctggaacctgcacgagctgacgcgggaactcggcctctcggcgttcgtgctcttctcgggcgccgccgccgcgttcggcgcggccgggcaggggaactacgccgccgccaacagcttcctggaagccctggcggagcagcgccgcgccgaaggcctgcccgccacctcactcgcgtggggcctgtgggctccgcagacgggcggcatggcccagcagctggacgaggtcgacctgcggcgcatcgccagggacggcgtcggcgggctctccggtgacgagggcctcggcctcttcgacaccgcgatgacggtcgacgcggcggtcctgctgcccatgcggctcgacctcgcggtggcgcgggcgcaggccgtctccacgggcgagacaccggcgctgctgcgcgccctcatacgggtgcccgcgcggcgcgcggtcgagcagcgtacggcggcggacggggcctcgcccctggcggccaggctgtccgccctgccggacgcggaacgcgaggacatgctgctggacctggtgtgcgggcgggtggccgaggtcctcggccacaccgacgcccgcgcggtcgacgcggaccgcgcgttcaaggaactcggattcgactccctcacggccgtcgagctgcgcaacgtcctgaaggccgcgaccggcctcaggctctcaccgaccctcgtcttcgactatccgaccccggtggcgctggcccggcacctgctcgccgagctggcgggaaccgccgatgaccaggacgccgtacgcggccggaaggcacccgcacggcccgccacggccgcggtcacctccgtgaccggcgaagacccgatcgtcatcgtcggcatgggctgccgcttccccggcggcgtacggtcgccggaggacctgtggcagctcgtcgccaccggcggcgacggcatcaccggcttcccgtccgaccgcggctggaacgtcgaggccctctaccaccccgacccggaccacgcaggcacctcgtacacccgcgaaggcggcttcctgcacgacgccgccgacttcgatcccgggttcttcgggatctcgccgcgcgaggccctcgccatggacccgcagcagcgcctgctgctggaaacctcgtgggaggcgttcgagcgggccggaatcgacccggcgacgctgcgcggaagccgtacgggcgtcttcgccggtgtcatgtaccacgactacgtgaccggcatcggcgacggcggcagcgccgtcgaactgcccgagggggtcgagggctacctcggcaccggcaacgccggcagcatcgcctccggccggatcgcctacaccttcggcctcgaaggcccggcggtcaccgtcgacacggcctgctcctcgtcgctcgtcgccctgcactgggcgatccaggcgctgcgcagcggcgagtgcacgatggcactggccggcggtgtcgccgtcatggccacccccgagaccttcgtcgacttcagccgccagcgcggcctctcggccgacggtcgctgcaagtccttcgccgcggcggcggacggtacgggctgggccgaaggcgcgggcatgctcctggtggagcgcctctccgacgccgaacgcaacgggcacccggtcctggccgtggtccgcggctcggcgatcaaccaggacggcgcgagcaacggcctgaccgcaccgaacggtccgtcccagcagcgcgtcatccgcgaggcgctggccagtgccgacctgtcggccgccgacatcgacgcggtcgaggcccacggcacgggcacccggctcggcgacccgatcgaggcgcaggcactcctggccacgtacggccgtgagcgcgaggcgggccgcccgctgtggctcggctcgatcaagtcgaacatcggtcacacgcaggcggcggccggtgtcgcgggcatcatcaagatggtcatggcgatgcggcacggcgtactgccgcagaccttgcacgtcgacgagccgtcaccgcaggtcgactgggaggccggtgaggtctccctgctgaccggggcgatgccctggccgcagacgggccgtccgcgccgtgcgggcgtgtcgtcattcggcatcagcggcaccaacgcccacacgatcatcgagcagccgccgacccgtgaggtgacgccgacggttccggtggctccggtggttccgacggttccgacggttccggtggtgccgtgggtgctctcgggcaagggcgaggaggcgctgcgagcgcaggcacgtcagctccagtcgtacgtgctccgcgcaccggaactgcgtccggtcgacatcgccggctcgctggcggtgggccgggcgtccttcgaggaccgcgcggcggtggtcgccgccgaccgcgaggggcttctggccgcccttgcggcgctggcggacggcggctcggcgacgggggctgtggagggttccgcggtgggcgggaagctggcgttcctgttcacggggcaggggagccagcggctggggatggggcgcgagctgtacgaggcgtatccggtgttcgcggaggcgttggatgcggtgtgtgctcgtcttgaactgcctttgaaggatgtgttgttcggggcggatgcgggtctgctggatgagaccgcgtatacgcagcctgcgttgttcgccgttgaggtggcgttgttccggctggtggagagctggggtctgaggccggacttcgtggcgggtcattcgattggtgagattgctgccgcccatgtggcgggggtgttctcgctggatgacgcctgtgctctggtggaggcgcgtgggcggttgatgggtgcgctgcctgcgggtggcgtgatgatcgcggtgcaggcgtcggaggacgaggtcctgccgttgttgaccgaccgggtgagcattgccgcgatcaacggtcctcggtcggtggtgatcgcgggtgacgaggccgacgcggtggcgatcgtggagtcgttcacggggcgtaagtcgaagcggcttacggtgagtcacgcgttccattcgccgcacatggacggcatgttggaggacttccgggccgtggcggagggcctgtcgtacgaggccccgcgcatccccgtcgtctccaacctcaccggcactctcgtcaccgacgagatgggctcggctgagttctgggtgcgtcatgtccgtgaggcggttcgcttcctggacggtattcgggctttggaggctgctggggttacgacgtatgtcgagcttggccctgggggtgtgctgtcggcgctggcgcaggagtgtgtcagtggggacggtgctgctttcgtgccggtgctgcgttctggacgttccgaggccgagactgcggtgaccgcgttggcccaggcgcatgtgcggggtgtgaacgtcgactgggccgcattcttcgccgggaccggcgctgagcgggtcgacctgccgacgtacgccttccagcggcagcgctactggctgcacatcccccgcgtcgcgcagagcggggtcgccgacgaggtggacgcccggttctgggatgccgtggagcgtgaggatctggagtcgctcgcctccaccctggaggtcgacgacgagagcgcgtggagcagcgtcttgcctgcgctgtcggcgtggcgtcgggagcggcgtgcccagtccgaggtggacggttggcgttaccgggtgtcgtggaagccgctggctgaggtctcggcgtcggggttgtccggttcctgggtggtgatctcgcctgctgggagtgtggacgactcggctgtggtgagtgcgctggttgggcgtggtgctgaggtccgtcgggttgtggtcgaggcgggtgtggaccgttcggcgctggctgggttgctggccgatgcgggttctgccgcgggtgtggtgtcgcttctcgggctggatgagtctgaggggttgttggggactgttggtttggtgcaggcgttgggtgatgccggggtggaggcgccgttgtggtgcctgactcgtggtgcggtctccgtcggtcgttcggatcggctggtgtcgccggttcaggctcaggtgtggggtctggggcgggttgccgccctggaggttccggagcgttggggcgggctggttgacctgccggaagtgctggatgagcgggctgtggcccgcttggtcggtgtacttgcgggttccggcgaagatcaggtcgcggttcgttcgtctggtgtgttcggtcgtcgtctggtgcgtgcaccgcgggccgagggtgcttcggcgtggacaccgaccggcactgttcttgtcaccggtggtacgggtgtgctgggtggccgggtggcgcgttggctggcgggggcgggcgctgagcgtctggtgctgaccagtcgtcgtggtccggatgctccgggtgcggctgagctggtggaggagctgaccaccggcttcggggtggaggtttcggtcgtcgcgtgtgacgcggccgaccgtgacgccctgcgcaccctgctctccgccgaggccgggactctgaccgctgtgatccacacggccggtgttctggacgacggcgtcctcgacgcgctcaccccggaccgtatcgacagcgttctgcgtgccaaggctgtctcggcgttcaacctgcacgagctgacggccgagctggggatcgagctgtccgccttcgtgctgttctcgtcgatgagtggcacggtgggtgcggccggtcaggccaactacgccgctgccaacgcctacctggatgctctggccgagcagcggcgcgccgatggtctcgcggcgacctcgctcgcttggggtccgtgggccgagggcggcatggccggcgacgacgcgatggacgcacggatgcgccgcgaggggctgcccccgatggcgccggacgcggcactgaccctgctgcgtcagagcgtggggtccgccgatgcggcgctgatggtggtcgacgtggagtggcagcggttcgcccctgccctgaccgtcgtgcgccccagcaacctcctcgccgagttgcccgaggctcgccccgccggaacggattcccgtacgggtggcgcaacgtcctccgagggggccggctcgttcgccgagcggttggccgccctgggtggggccgagcaggacaaggagctgctgaacctggtccgtacgcatatcgccgccgtactcggacatggcggctcggaggccgtgggtgccgaacgggccttcaaggaactcggcttcgactccctgaccgccgtcgagctgcgcaacaggctcggtgccgcgaccggtgtacgtctcccggccacgctgatcttcgactacccgaccgccacggctctcgccgcctacctgcggggcgagttgctcggtacgcaggtcgtggtgtccggtccggtgtccaacggcgtcgtcgtggacgacgatccgatcgcgatcgtcgcgatgagctgccgcttccccggtggcgtacggacgccggaagacctgtggcggctgctgtcgaccggcggtgacgccatcggtgagttccccgccgatcgcggctgggatctgagtcggctctacagccccgaccccgacaagcagggcaccttctatgcccgcgcgggcggtttcctctacgacgccgccgacttcgacgcggacttcttcgggatctcgccgcgcgaggccctcgccatggacccccagcagcgactgctcctggagacgtcctgggaggccttcgagcgggcgggcatcgacccgtcgtcgctgcgcggcagccaggccggtgtcttcgtcggcaccaacggccaggactacggagcgatgctccagaccatcccggacggcatcgagggcttcctcggtacgggcaacgcggcgagcgtcgtctccggccggctgtcctacgccttcgggctcgaaggtccggccgtcacggtggacaccgcctgctctgcctcgctggtcgcccttcactgggcggtccaggcgctgcgcagcggcgagtgctcgctcgcactggccggtggcgtgaccgtcatgtcctcgcccggtgcctacatcgacttcagccgtcagcgtgggctcgcggaggacggtcgtatcaaggcattcgcggcagccgcggacggtacgggctggggcgagggcgtcggcatgctcctcgtggagcggctctccgacgcccgcaggaacggtcacccggtcctggccctggtccggggctcggccatcaaccaggacggcgcgagcaacggcctgaccgcgccgaacggcccctcgcagcagcgtgtgatccgccaggccctggccaacgcgggcttgtccgccgcggaggtggacgcggtcgaggcgcacggcaccggcacgaggctcggcgacccgatcgaggtgcaggcactcctggccacgtacggccgtgagcgcgaggccgaccagcccctgtggctcggctcgatcaagtcgaacatcggccacacgcaggcggccgccggtgtcgcgggagtcatcaagatggtcctcgccatggagcacggggtgctgccgcagaccctgcacgtggacgagccgactccgcacgtggactggtcggcaggcgatgtcgccctgctgaccgacgccgtggagtggcccgagaccggtcgcccgcgtcgagcgggtgtgtcgtcgttcggcttcagcgggacgaacgctcacacggttctggaacaggcaccgaagcccgaggagcctgaggagtctcagcagcctgaggagacgaacgcgcccgcccgaccgcatcagtccggagtcatgccgtggacgctctcggcgaagagcgaggcggcgctgcgggtccaggccgagcggctgcggacgcgcatcgcttccgacccgctgctccagcccgtcgacgtggcctactcactcgcgacatcgagggccgcccttgagcggcgcgccgtggtcgtcgcgacggaacgtgacgagttcctggccggactcaaggcgctggcctccgggcagcctgctccgggcctggtgcagggcagggtgaccgagggcgggctggcgttcctgttcacggggcaggggagccagcgactggggatgggccgggagctgtacgagacgtatcccgtcttcgcggatgcgctcgacgcggtgtgtgtgcgtcttgaactgcccttgatggatgtgctgttcggaaccgagcgcgacgcgctggacgagaccgggtacacccagccggctctcttcgcggtcgaggtggcgttgttccggctggtggagtcgtggggtgtgaggccggacttcctggccgggcactcgatcggtgagatcgcggccgcgcatgtggcgggagtgttctcgctggatgacgcctgcgctctggtggaggcgcgtgggcggttgatgcaggcgctgccgaccggcggcgtgatgatcgccgtccaggcgtctgaggccgaggtcctgccgctgctgaccgagcgcgtgagtatcgccgcgatcaatggtccgcagtcggtcgtgatcgcgggtgacgaagccgatgcggtggccctcgtggagtccttcacgggccgcaagtccaagcggctcacggtcagtcacgccttccactcgccgcacatggacggcatgctcgccgacttccgcaaggtggcggaggggttgtcgtacgaggccccgcgtatcccggtcgtttcgaacctcacgggggccctggtcaccgacgagatgggctcggccgacttctgggtgcggcacgtccgcgaggccgtccgcttcctggacggcacccgcacgctggaagccctgggcgtcacgacgtacgtcgaactcggccccgacggggtcctgtcggcgatggcccaggagtgtgtgaccggcgaggactccgtcttcgtgccggtcctgcgctcgggtcgtcccgaggccgagagcgtcaccacggccctcgcccaggtacacgtccgcgggatcgccgtcgactggcaggcgtacttcgccgggaccggcgcccagcgcgtcgacctcccgacctacgccttccagcgccggcgctactggttggaagaggctcccgccacggcggccgtcgagcccctgaccggctcgctcggggccgtggacgcgcagttctgggcggccgtcgacaacgcggatctctccgcgctcaccgccaccctggacatcgacgtcgacgccgaccagccactgagcgccctgctgcccgcactgtccgcctggcggcggcagcgtcaggagcagtcggtcgtcgacggctggcgctacacggtcacatggaagccgatggccgatccggccgtcgcacggccgaccgggacctggctcgtcgtgacccccgccaccagccttgtcgacctgcccgcggtctccgccgcgttggcagcgcagggagtggacgtacgggaagtcgccctggaggcggccgagttggatcgcgacggcgtggcgggccggatgcgtgaggcgctcgcgggcgaccgggccgacggggtgctgtccctgctggcgctcgccgaacacccgcacccggcccatccggcggcgcccaccgggctgctcctgaccgggacgctcgtacaggcactcggtgacgccggagtcgacgccccgctgtggtgcctcaccaccggcgccgtggcgaccgcaccctccgacctgatcgggagcgcggcgcaggcgcaggtctggggcctcggccgggtcgtcgccctggaacaccccgagcgctggggcgggctcgtggacctgcccgtaccggcggacgagcgggcactcgaccggctgctcgccgtcctcgcgggcgccggggacgaggaccagatcgccgtacggtccgcgggcctcctcgcccgccgcatcgggcacgccgcgcctcccgccgccgggcagcacgccgacagcgggacatcgggcgccggcgctgcggccggctccgcctggcggccgcgcggcaccgtcctggtcaccggaggcacgggcgcgctcggcgggcacgtcgcccgctggctcgcggcacacggcgcggaacacctggtgctgctcagcaggaggggcccgcaggcgcccggcgccgatgccctggtcgccgagatcgccgcgctgggtgccggggccacggccgtcgcctgtgacgtgaccgaccggaccgccgtgtcggagctgctcgccgggctcgccgacggcacgtacggtcccggcctcaccgccgtcttccacacggcgggcgccgggcagttcgcgccgctcgacgggaccggccccggcgaggtcgccgaggtcgtcgccgccaaggtcgcgggcgccgcccacctcgacgagctgctcggggacacggaactggacgccttcgtcctcttctcctccatcgccggcgtctggggcagcggcggccagagcgcctacgcggcggccaatgcccacctggacgccctggcccagcagcgccgggcccgcggactgacggccacgtccgtggcctggggcccgtggggcgagggcggcctggtcgccgacgacgaagcggccgaacaactgcgccgccgcggcctgcccgtcatggcgccggagctgtcgatcgccgccctccagcaggcgctggacggggacgagacggcggtgacggtggccgatgtcgactgggacctgttcgtgccggccttcaccgccgcccggccgcgtccgctgatcaccgacctccccgaggtgcgccgcgctctggcggcagagcaggacggagccgccaccgcggccggggaagcggccggcctcgaagccgagctgcgggggatgagcggaaccgaggcggagggcgtcgtcctgaacctggtccgtacgcaggtcgccgtcgttctcggacacgggggagcgacggcggtcgaggcggcccgcgccttcaaggaactgggcttcgactcgctcaccgcggtcgagctgcgcaaccgcctcagcaccgccaccggactgcggctgcccgcgagcctggtcttcgactacccgaccccggccgcactggccgcgcacatccgggcggaactcctcggcgaggacaccacgcccgaactgcccgccctcgcggagatcgacaagctggaattcctcctctcgtcggttcccgaggacaccaccgaacgcgcccgcgtcaccgcacggctcgaatcgctcctgtcgaactggaacagggcagaacgagcggtcatcggagaggacgaagaaatatccatcgaatcggcatccgccgacgacctcttcgacatcatcaacaacgaattcggaaaatcctgacctgatgaccgatccgatgaccgatccgaattccgatccaatgtccgtatgcattccgcaattccccaggaggtgacgttccagtggccagcgcgaacgaagaaaagcttctcgaaaacctgaagtggatgaccaatgagctgcggcgggcccgccgtcgcctccatgaggtcgaggcggacgcccaggaaccgatcgcgatcgtcgcgatgagctgccggttccccaacggggtgggatccccggaggatttgtggcgcctggtcgacgagggcggcgacgccatcaccggattccccgccgaccgcggctgggacatcgagtcgctcgccgatccggaccccgaccgcaagggcaccttctacaacaccggcggcggattcctcgacggggccaccgcattcgatcccggatttttcggcatatcgccccgcgaagcgctcgccatggacccgcagcagcgccagctcctggagacctcgtgggaggtattcgagcgcgcgggcatcgaccccgcggccgtacgcggcagccgcaccggcgtctacgtcggcgcgggcgcgatggggtacggagccgacctcaaggaagcgccggaagggctggagggactgctgctgaccggcggcgccaccagcgtcctgtcgggacgggtcagctacgtgttcggactggagggccccgccgccaccgtcgacacggcctgctcctcctcgctcgtcgccctgcacctcgccacccaggccctgcgtcagcgcgagtgctcgctcgcgctggtcggcggcgtgtgcgtgatgcccagccccgatgtgttcgtcgagttcagccgccagcgcggcctgtcgcccgacggccgctgcaagtccttcgccgcgtccgccgacggcaccggctggtccgaaggcgtcggtgtcctcctggtggagcgcctctccgacgcccgtaggaatggtcatccggtcctcgcggtggtgcgtggctcggccgtcaatcaggacggcgccagcaacggcctgaccgcccccaacgggcccgcccagcagcgcgtcatacgccaggccctggagaacgcccggctgtcggcggccgaggtcgacgtcgtcgaggcccacggcacggggaccacgctcggcgaccccatcgaggcccaggcactcctcgcgacctacgggcaggaccgccccgagggccgccccctgcgcctggggtccctcaagtccaacatcggtcacacgcaggccgccgcgggtgtcgcgggcatcatcaagatggtcatggcgatgcggcacggcgtactgccgcagaccctccacgtcgacgagccgaccccgaacgtcgactggaccgcgggcgccgtttccctgctcaccgagccgatgccctggcccgagaccggcgcgccccgccgcgcggccgtctccgcgttcggcgtgagcggcaccaacgcgcacaccatcatcgaacaggcccccgagccggacgccgagtccgtgtccgtgtccggctccgcgcccgcggcggctcccgccgtcccgacccctgtcccgaccctcgtcccggcggtcctgccctggacactctccggcaggagcaccgcggcgctgcgcgcccaggccgccagacttctcaccacccagggccaggacggtgcgaccgaacccgggcgtcccctcgacatcggctactcactggccaccacccgcgcagcccttgagcaccgcgcggtgctcctcgggcgtacggaggacgactttgccgccgccctctcggcgctcgccgagggtgcggagtccgcaggcctggtacagggcagggtgaccgagggcgggctggcgttcctgttcacggggcaggggagtcagcggctggggatgggccgtgagctgtatgaggcgtatccggtgttcgcggatgcgctggatgcggtgtgtgcccgtcttgaactgcctttgaaggatgttctgttcggggcggatgcgggtctgctggacgagaccgcgtacacgcagccggcgttgttcgccgttgaggtggcgctgttccggttggtggagagctggggtgtgaagccggacttcgtggccgggcattcgatcggtgagatcgcggccgcccatgtggcgggggtgttctcgctggaggatgcgtgcgcgctggtgtcggctcgtgggcggttgatgggcgcgctgcctgcgggtggcgtgatgatcgcggtccaggcgtcggaggccgaggtcctgccgctgctgaccgaccgggtgagcattgccgcgatcaatggtccccagtcggtcgtgatcgcgggtgacgaggccgacgcggtggcgatcgcagggtccttcgccgaccgcaagtccaagcggcttacggtcagtcacgccttccactcgccgcacatggacggcatgttggaggacttccggctcgtggcggagggcctgtcgtacgaggccccgcgcatcccggtcgtctcgaatctcaccggtgctctcgtctccgatgagatgggctcggctgagttctgggtgcggcacgtccgcgaggccgtccgtttccttgacggcatccggacgctggaagccgctggcgtgaccaagtacgtcgaactcggccccgacggcgtgctgtcggcgatggcccaggactgcgtgagtggcgagggctccgtcttcatccccgtgctccgcaaggcacgccccgaggccgagagcgtcaccaccgccctcgccacggcccacgtccacggcatccccgtcgactggcaggcgttctacgccggaaccggcgcccagcgcgtcgacctccccacctacgccttccagcacgagcgttactggctggagcccgccaccggcggagccggtgatgtgagcggagccgggctcgacccggccgggcatcccctgctcggcgcggccgtcaccctggccggctcggacagtgtgctgttcaccggtcggctctcgctccgcacgcagccctggctcgccgaccacaccgtgtccggtaccaccgtgctgccgggcgccgcattcgtcgaactcgccgtgcgtgccggtgaccaggcaggctgcgagcgggtcgaggcgttggtgctcgatgcgccgctcgccctgcccgcggagggcgccgtacgcgtccaggtgctcgtcgaggcgcccgacgagcagggccgccgtcccttcaccgtttcctcccagccggagaccgcgccggccgacaccccctgggggcggcacgcccggggcgtgctcgcgcccacggcccccgcaccgtcgttcgatctggcgcagtggccgcccgccggggccgaggccgtggacatcacggacctctacgcgtcccacgacacccctggcgcgcacgggcccgagcgcggtggcctgttccgtgccgtggaggccgtctggcgctgtgacggtgacctcttcgccgaggtgcgtctgcccgagggcggcccggacgcacaggccttcggcctgcacccggcgctgctcgacgccgccgcgcacgcggcctcggtactggacgagcagcacggaacgggggcagggctgggcacgtggtccgatgtgactctgcacgccgtgggcgccggcgccctgcgcgtacggatacggtcggccctcgacggcactgtgggcctggacctcgcggacgacctgggtgaaccggtggcgaccgtgggcgggttgactccgcgacccttcgcgcaagcgggttcaggtggacaggttgtccagcatgacgcgctgttccagctcgactgggtgcggctgccgctcgccgaccgctcgtccgctcccaccggggagtgggccgtactcggctctgccgacgggttcgcggacctggaggcgctgggcgcagcggtcgacgcgggtgctcccgtaccgccgtacgtcgtcgtccccttggagcggcaggccaccggcaacgggtcggacgccctgcacgaggccgtgcaccgggcgctcgccctggtgcggtcctggctggacgaccagcgcttcgagacctcgcgcctcgtggtcctgacccgaggcgcggtcgccgggcccggcgaaggcgtcgaggacctgccgcatgccgcggtgtggggcctggtgcgttcggcggagacggagaaccccggccgtttcgttctcgccgacgtagacgtagacctcgacgcggacttgggctcaggcgtgggcctcgccgccgtactcgcctccggtgagccggagttgctgctgcgggacggagtcgtacacgccccccggctgaaccgggcccgtaccgccacctcgtccgacgcccccggcatcgatccggccggaaccgtcctgatcaccggtgggtccggcacgctcgccggtatcgtcgcccggcacctggccaccgcccacggtgtgcggcgtctgctgctgctgagccgcaggggcgccgatgcccccggtgccggtgaactgaccgctgagctggccgggttgggcgcgcaggtctcgtgggcggcgtgtgacgcgggtgaccgcgacgcgctcgcggccgtactggccgccgttcccgcagcgcacccgctcaccgcggtcgtccacacggccggtgtcctcgacgacggcgtgatcggttcgctcaccccggaacgtctcgacacggtccttcgcccgaaggccgatgccgctctccacctgcacgaactgacccgcgacctgcccctgaccgccttcgtcctcttctccgcgatcgccggaaccctcggcagtgcgggtcaggccaactacgcggccgccaacgtcttcctggacgctctggcccagcaccgccatgaccaggacctgccggccacctcgctcgcctggggcctgtgggccgatgccagcgggatgaccggcggcctcgacgaggcccagctgcggcgcatggagcagcacggcatgggcacgctctccgccaccgacggcatggcgctgttcgacgccgccctcgccgccggccggccggtcctcgtcccggcccgtctgcacctccccggcctgcgcaatgccgccgggccgggcccggtggctccggtgttccggtcgctcctgggtgcctcgggccgccgggccgcgcggacccgtaccgacggcggcaccccgctcgccgagcggctgacccgcctcgccggtcccgaacaggaccgggcgctgctcgatctcgtacgggcacaggtcgcatccgtactcggccacgcctcggccgaacaggtggaccccgcacgcgcgttcaaggatctgggcttcgactccctgaccgccgtcgagctgcgcaaccggctgggcgccgccaccggactccggctgccgaccacgctcgtcttcgatcatccgacgcccaccgcgctcgtccggcacttgcgtacggaccttctcggcgccgcgccggaccccggagccgacgccccgggcctgcccgcgcgcgtcggcctcgccgacgacccgatcgccatcgtggccatgagctgccgctaccccggcggtgtccgcacccccgaggagctgtggcggctcgtcgagaccggtggcgacgcgatcgccggactcccgggcaaccgggggtgggacaccgacgcgttgcacgccgacgaggacggccggaccttcgcgggcggcttcctgtacgacgccgactcgttcgacgcggacttcttcggcatctcgccgcgcgaggcgctcgccatggacccgcagcagcgactgctgctcgaaacctcctgggaggcgatcgagcgcgccgggatcgacccgtcgtcgctgcgcggcagccgggccggtgtcttcgtcggcgccgcctacagcggctacgacgcgcaattggagcagtccggagtggacggtgtcctcggccatgtgatgaccggcaatgcgggcagtgtcatgtccggccgtgtgtcctacgcgctgggcctggagggtccggcggtcacggtcgacacggcgtgctcgtcctcgctggtcgccctgcactgggcgatccaggccctgcgcaacggcgaatgctcgctggcgctcgccggtggtgtgacggtgatgtcgaccccgggcaccttcagcgagttcagccagcagggcggcctgtcaccggacggccggtgcaaggcgttcgcgtcggccgcggacggtacgggctggggtgagggtgtcgggatgctgctggtggagcggctgtccgatgcccgtaggaatgggcatccggttctggcggtggtgcgtggttcggctgtcaatcaggacggtgcgagcaatggtctgacggctccgaatggtccttcgcagcagcgggtgatccgtgcggcgttggcgagtgcgggtctgtcggccgctgatgtggatgtggtggaggcgcacggtacggggacgaagctgggtgacccgatcgaggcgcaggcgctgctggcgacgtacgggcaggaccggcccgatggccgtccgctgtggttgggttccatcaagtccaacatcggtcacacgcaggccgccgccggtgtcgcgggcatcatcaagatggtcatggcgatgcggcacggggtgctgccccggaccctgcacgtcgacgagccgacctcgcatgtggactggtcggcgggcgaggtgtccctgctgtcggagtcggccgaatggccgctcaccgagcggccccggcgagccggagtgtcgtccttcggcatcagcggcaccaacgcccacaccatcatcgagcaggcgccggagaccgggaccgaggcggagccgtcggcggagaccctcacgcacgggaccgtgccctacgtcctctccgccaagagctccgacgctctccgcgcccaagcgcggcagctgcttgccgtggtggaagccgccgagagcccccgagtcgccgatctggcctactcgttggccaccagtcgggccggtctcgatcaccgcgcggcgctcgtcgccgacgaccgggagaacctgacgcgggcgctcgcggccctggcggcggacgagcaggtgcccggcctggtgcggggcacggccaccggtggcggcctcgccttcctgttcacggggcaggggagtcagcggctggggatgggccgggagctgtacgagacgtatcccgtcttcgcgcgggctctcgacgcggtggacgcacgcctggaactgcccatgaaggaggtgctgttcggcgcggacgcggatctgctgaacgagaccgcccacacgcagccggctctcttcgccgtcgaggtggcgctgttccgtctgctggagtcgtggggcgtgcggcccgacgtcctggccgggcactcgatcggtgagatcgccgcggcccatgtggccggggtgttctccctggacgatgcgtgcacgctggtcgaggctcgcggtcggctcatgcaggcgctgccgaccggcggcgtgatgatcgccgtccaggcgtcggaggacgaagtcctgccgctgctgaccggccaggtgagcattgccgcgatcaacggcccccagtcggtcgtcatcgcgggcgacgaggccgacgcggtcgcgatcgccgagtccttcaccgaccgcaagtccaagcggctcaccgtcagccacgccttccactcgccccacatggacggcatgctcgccgacttccgcaaggtcgccgagggcctcgtctacgagaacccgcgcatccccatcgtctcgaacctcaccggcactctcgtcaccgacgagatggcttcggccgacttctgggtccgccacgtccgcgaggccgtccgtttcctcgacggcatccgcgcgctggagagccgcggggtcaccacctacatcgaactcggccccgacggggtcctctccgccctcgcccaggactgcctcaccgccgggaccgggaccgggaccgcgatcttcgctcccgtactccgggcggcccgtcccgaggccgagagcgtcaccaccgccctcgccacggcacacgtccacggcacccccgtcgactggcgggcgtacttcgccgggaccggtgcccggcgcgccgacctccccacctaccccttccagggcaggcgctactggcccgaagccgccgccccgagcggtgcggcggccggactcggggaccaggcggtcgacgcgcgcttctgggacgcggtcgagcgggcggacctgggctccctgatcggtgggccggagatcgacggggaccagccgctcagctccgtactgcccgccctctccgactggcggcgcaaccagcaggcgcagtcgcaggcggacgcccggctctaccgcatcgcgtggcagccgtggtccggggccggccggggcacacccgcgggtacctggctggtggccgtgccggcgccgtacgcggacgatccgtgggtccgtgcgctgaccgaccgcatggccgagggtggcgcggaggtcgtaccgctcacgctcgatgtcgccgacagcgacccggcgtcgctgcgcgcccggctggacgagcggctgcgcgaggcggtgggcgacggcccggtggccggtgtcctgtccctgctcgcgctggacgagcggccccaccccgaccacccgagcgtgcccgtaggactggccctcaccagcgccctcacctccgtgctcaccccggtgctcacggaaccggacccggaaggcggggcgagcggaggcatcgaagcaccgctgtggtgtgtcacgcgtgacgccgtcgcggcagccggtggtgacgaactcggcggcgccgcccaggcgcaggtctggggcctcggccgcgtcgtcgccctggagcaccccgaccgctggggcggtctcgtcgacctcccggcggtatgcgacgaccgggtcctgtcccggctgatggcggtgctcgcaggatccggtgacgaggaccaggtggcggtccgtacctccggcaccctcgtacgacggctcctgcgggccgccccgacgagcgtgccgtccgcaccctggaccccgcgcggcacggtgctcgtcaccggcggcacgggcgccctcggccgccatgtggcgcgccacctcgccgagcggggcgccgaacggctcgtgctcgtcagccgccggggcgccgacgcgcccggtgcggccgagaccgaggcggaactctccgcgttcggcgcggccgtgaccctcgtggcctgcgacgtcgccgaccgcgatgcgctcggaacgctcgtcgcgcggctcgccgccgacggcactccggtccgtgccgtggtgcacgccgccggtgtctcgcagccgccaggtacgggaacggacctccccgggttcgcccgtgtcgtggccgcgaagacggcgggagccgtccacctcgacgcgctgttcgacgcgccggactccctcgacgcgttcgtcctcttctcctccatcgccggtgtctggggcagtggcggccaaggggcctactccgccgccaacaccttcctcgacacgctcgccgaacggcgccgggcccgcggtctcgccgccacggcgatcgcctggggaccgtgggccgacggcggcatggccaccgagggcgacgcggaggagcagctgagccgacgcggcctgccgcccatggaccgggcgacgaacctgctggcgctggagcgtgccgtcgcgggccgggaggcggcgctgaccgtcgccgacgtcgactgggcgcgcttcgcacccgtgttcgccgcggcccgcccccgcccgctcatcggcgacctgcccgaggtacgggacgcactgcgcggggacaccccggccggggaaggaccggccgagaccgcttcctccgccgtactccggaggctgacggaactcaccggggcggaccgggaaacggccctcctcgacctcgtgcgcgagcacgcggcaacggccctgggccacacgtccgccgacgcggtcgcggccgaacgggccttcaaggacctcggcttcgactcgctcaccgcagtcgaactgcgcaaccgcctcggcgccgcgtgcggcctgcggctgccctccagcctcgtcttcgactaccccaacccgcaggcgctcacccggcacctgctgcacaccctcttccccgaaggggcgggcgggccggacgtaccggctctggacaccgacccccaggaagcggaactgcgccggacgctcgccgccatcccgctgggccggatccgcgaggcagggctcctggacacgctgctccggctcgccggacccgacacccccgctcccgccacgagtaccgccgacgagagcgagtccatcgacacgatggatctccaggacctcctcgacctggcgctcgacggcggcggcgatcccgacggcctcaacggcctcgacagcctcgacggccccagtggcaacgacaacgacagcaaccgattctgacgtgcccgaagtgcggagtaagtgatgacaacccccaacgaaaaagtcgttgaagcgctgcgggcctccctcaaggaaaccgagcggctgcgccgccggaaccaggagctcaccgacgccgcgcgcgagcccatcgcgatcgtcggcatgagctgccgcttcccgggcggagtcagctcgcccgaggacctgtggagactcgtcgagagcggtggcgacgccatctcgggcttccccgtcaaccgcggctgggacatcgagtcgctgtacgaccccgatccggaccacgagggcaccacctacgcccgcgacggcggcttcctccacgaggcggccgacttcgaccccgcgttcttcgggatctccccgcgcgaggccctcgccatggacccgcagcagcggctgctcctggagaccacctgggaggtcttcgaacgagccggaatcgatcccgcgtcgctgcgcggcagccgggccggcgtcttcgtcggcgcgtccgccaacgcctacggagccggctcccacgaccttcccgacggcgtggagggacacctcctcaccggcaccgcgtccagtgtcctgtccggccggctcgcctacgtcttcggcctggagggccccgccgccaccatcgacacggcgtgctcgtcctcctccgtcgccctgcacatggccgtccaggcgctgcgccagggcgagtgctcgctcgcgctggccgcgggcgtcaccgtcctcgcgggcccggacgtcttcgtcgagttcagccgccagcgcggcctgtcgcccgacggccgctgccggtccttcgccgagtcggccgacggcaccggctggtcggagggcgccggcgtcctcctggtggagcgcctctccgacgcccgccgcaacggccaccacatcctcgccgtggtccgcggctcggccgtcaaccaggacggcgccagcaacggcctgaccgcccccaacgggcccgcccagcagaaggtcatccgccaggccctggagagcgcccggctgacccccgcggacatcgacgcggtcgaggcccacggcaccggcacgaccctcggcgaccccatcgaggcgcaggcgctcctcgccacctacgggcaagggcgcacggacggccggccgctgtggctcggctccttgaagtcgaacctcggccacacccagaacgccgccggtgtcgccggcatcatcaagatggtcatggcgatgcggcacggggtgctgccccggaccctgcacgtcgacgagcccacctcgcacgtcgactggtcgacgggcgcggtggcgctgctgaccgagccggtggagtggccggagaccgggcgcccgcgccgggtcggcgtctccgccttcggcgtcagcggcacgaatgtgcacacgatcatcgagcaggccccggcccctgccccggcccccgtcgcggacgacacatcggaaccggcgcccgccgcccggccgaaggcgctgccctggctcctctccgcgaagggccgggacgccctgcgcgaccgggccgcacagctgctcgcgtacgccgaggaacaccccgacctgcggccggtcgacatcgccgggtcgctggcggtgggcaggccgtccttcgaggaccgcgccgcggtggtcgccgccgaccgcgaggggctgctggccggcctcgcggcactggcggacggcggctcggcgacgggtctcgtcaaggggtcgtcgcagctcgtggggaagctggcgttcctgttcaccgggcaggggagccagcggctggggatgggccgtgagctgtacgagacgtatcccgtcttcgcgcaggccttggacgcggtgtgtgagcggctggaactacccctgaagaacgtgctgttcgggacggacagcgctgcgctggacgagacctcgtacacgcagcctgctctcttcgccgttgaggtggcgttgttccggctcgtggagagctggggcctgaagccggacttcctggccgggcattcgatcggtgagatcgcggccgcgcatgtggccggggtgttctcgctggacgacgcgtgcgcgctggtgtcggctcgcggccggttgatgggggcgctgccgggcggtggcgtgatgatcgcggtccaggcgtcggaggacgaggtcctgccgctgctgaccgatcgcgtgagcattgccgcgatcaacggtccgcagtcggtcgtgatcgcgggtgacgaagccgatgcggtagccatcgccgagtccttcgcggaccgcaagtccaagcggctcacggtcagtcacgcgttccattcgccgcacatggacggcatgttggaggacttccgggtcgtggcggagggtctgtcgtacgaggctccgcgcatcccggtcgtctcgaacctcaccggcgctctcgtctccgacgagatgggctcggccgacttctgggtccgccacgtccgcgagaccgtccgcttcctggacggtatccgcaccctggaagccgctggcgtcaccaagtacgtcgaactcggcccggacggcgtgctgtccgccctggcccaggactgcgtgagcggcgaggactccgtcttcatccctgtactccgcaaggcacgccccgaggccgagacggtcgccaccgccctcgcctcggcccacgtccacggcatccccgtcgactggcgggcgtacttcgccgggaccggcgcccagcgcgtagacctccccacctaccccttccagcgccagcgctactggatcgagccgggcggccgtgccggagacgtgggcgcggccgggctggaggaggcggggcatccgctgctgggtgcggccgtaccgctcgccgactccgagggcttcctcttcaccgggcggctcggtcgcacctcgcacccctggctggccgatcacgcggtcatggacaccgttctgctccccggcacggccttcgtcgacctcgcggtgcgcgccggtgaccaggtcggatgcgatgtcgtcgaggagctgacgctggaagcgccgctggtgctgcccgagcgcggtgccgtccagatacagatgcacgtcggcgcgcccgacgcggacggtacgggacggcggacgttcaccctgtcctcgcgtacgcaggacggcgcggccgacgaaccgtggacgcggcacgccggcggcgtcctcgcgcacggcgcggcgcaaccggccttcgcgccggtccagtggcccccggcgggtgccgagccgatcccgacggagagcctgtacgcggacctggccgaggtcggcatgggatacggacccgcgttccgcggcctcacggccgcctggcggcacggcgagagcgtctacgtcgaggtcgcgctccccgaggaaaccgcctccacggcacgggacttcggcctgcaccccgccctcctggacgcggcgctgcacgcgctgggtctcggcgtactgggtggcgtcgagggtgaagggcggctccccttcgcgtggagcggtgtgaccctgcacgcggccggagcggacgcgctgcgcgtgcacctcgctccggcgggcgcccacggcgtacgcctggagatcgcggacgccgcgggcgcacctgtcgcgaccgtcgactcgctcgtcctgcggaccgtatcggaggagcaggtacgcgccgcgcgcaccgcgtaccacgagtcggtgttccgggcggagtggacggccctgccgaccgccgccgaatccgcggccacgcatggccgttgggccgtgctgggagcggcggacgcgggcgattcgccgcgcgacgcgctggtgaacgggctgctcggccacctgcccggcgaggtcgcgcgctacgccgacctggccgagctggcggcggccgtcgaggccggagcggccacgccggacgccgtgttcgccgcgtacgcgcggtccgatgacgacggaccggccgcaccggacgtgtccgcaccggacgtgtccgcgcaggcggtgcacgcggccacccacgacgccctcgcactcgtccagacgtggttcggtgaggagcccttcgccggggaccggttcgccgccacccgcctggtcgtgctcacccggggcgcggtcgcggcgggcgacggcgacacggtcaccgaccccgcacacgcggccgtctggggtctgctgcgctccgcgcagtccgagtaccccgaccggctgctgctgatcgacaccgacggggtcgaggactccgtacacgccctgcccgccgtgctcgccgtcggagagccgcaactcgccctgcgtgcaggctccgtacacgcgctccggctcgcccgcgtggccgccgcgacgccggaggacgccgccgctccgacgcagtacgcgcccggatcgacggtgctgatcaccggcgcgggcggcatgctcggcggtctgatcgcccgccgtctcgtcgccgaacacggcgtacggcacctgctgctggtgggccgccgcggcgccgccgctcccggagcggaacagctgagcgccgaactggccgaggcgggcgcctcggtgacctgggccgcgtgcgacgtcgccgaccgggacgccctctcggccgtactgcacgcgatacccgccgagcacccgctcggcgcggtcgtccacaccgctggtgtgctggacgacggtgtgatcgcctcactgacccccgagcggctctcggccgtgctgcgccccaaggtcgacgccgcctgcaacctccacgagctgacccggcacctcgacctcacggcgttcgtgctcttctcctccatcggcggcgtcttcggcggcccgggacagggcaactacgcggcggcgaacgtgttcctcgacgcactcgcccagcaccgccgctcccagggactcgccgccacctccctggcctgggccctgtgggccgacagcacgggcatggccggcagcctcgacgaggccgacatcagccggatgcggcggggcggcctgcccccgctgaccacggccgagggcctggaactgttcgacctcgcccaccgcatcgacgaggccgcaccggtcctgatgcgcgccgacctgaccgccctgcgcacgcaggcccaggccggcacgatgtcgccgctgctgcgcggtctcgtacgggtccccgcgcgccgcagcgccagtggcgcggccggtacgggcggtgagtccggactgcgcgagcgcctcgccggactctcggccgccgaacgggaccgtacgctgctcgacctcgtccgcaagcaggtcgccgcggccctcggctaccccggaccctccgccgtcgagcccggccgctccttcaaggaactcggcttcgactcgctcaccgccgtcgaactgcgcaacctgctcggcgacgccaccggccgccgcctccccgccaccctcgtcttcgactacccgacggcgaccgccctcgccgggtacctccgcgaggagatcatcggagacctggcggacgccgtcaccgccccggccctcgtgccgtccgcggccgtggcgggcgcgggcgcgggcgcggacgacgacgatccgatcgcgatcgtcgccatgagctgccggttccccggagggatcgcatcccccgaggacctgtggcagctgctcgtcaccggccgcgacggcatcacgggcttcccggcggaccgtggctgggacctcgacagcctctacagcgacgaccccgaccgcgagggcacgagctacgcccgcgagggcggattcctgcacgaggccgccgagttcgacgcctccttcttcgggatctcgccgcgcgaggccctcgccatggacccgcagcagcggctgctcctggagaccacctgggagacgttcgagcgcgcgggcatcgacccgaccagcctgcgcggcagccggaccggcgtgttcgtcggctccaacgcccaggactacctccagctctggctgaacgacgcggacggcctcgaaggacacctgggcaccggcaacgcggccagcgtcgtctccggccgcctctcctacaccttcggcctggagggcccggccgtcacggtcgacacggcctgctcgtcctccctcgtcaccctgcacctggccgcccaggccctgcgccgcggcgagtgctccatggcgctcgccggcgcggtcaccatcatgtccacgcccggcgcgttcaccgagttcagccgccagcgcggactcgccgccgacggccgcatcaaggcgttcgccgccgccgccgacggcacgagctggtccgaaggcgtcggcctgctgctcgtcgagcggctctcggacgcacggcgcaacggtcacccggttctggcggtggtgcggggcaccgccgtcaaccaggacggcgcgagcaacggcctgaccgcgccgaacggcccgtcccagcagcgcgtcatccgcgaggcgctggccgacgcgggcctgtcggccgccgaggtggatgcggtcgaggcccacggcaccggcacgaccctcggcgaccccatcgaggcgcaggcgctcctcgccacgtacggccagggccgcccggacgaccagccgctgtggctcggctccgtgaagtccaacatcggccacacccaggccgtggccggagccgccggcatcatcaagatggtcatggcgatgcgccacggcgtactgccgcagaccctgcacatcgacgagccgacgccgtacgtggactggtcggcgggcgacatcgccctgctgaccgagcagcgggcgtggccggagaccggccgcccgcgcagggcgggcgtctcctcgttcggctacagcggaaccaacgcgcacgccgtcatcgagcaggcaccgcagaacgcgatggagcggaccccgcagggcgacaacctgccggcccgcacccccgcgacgcggaccctcccggtgctgccgctgctcgtctccggccgcacggcgccggccctgcgagcccaggcggaacgcctgcgaccggccgcgaccgccctcgcgacgggcacggtaacgaactccggagctttggaagcactcgacctgggctactccctggccacgagccgcgccgcactggaacaccgggcggtcctgatcggcaccccgtcggacggccaggcactggcctcgcgactcgacgccctggcggcgggcgagcaggtgcccggcctggtgcagggcacggcttccggtggcgggctcgccttcctgttcacgggacaggggagccagcggctggggatggggcgcgagctgtacgagacgtacccggtgttcgcggaggcgttggatgcggtgtgcgcccggctcgaactgcctttgaaggaggtgctgttcggggcggatggcgctgcgctggatcagacggcggtgacacagccggccctcttcgccattgaggtggcgttgttccggctggtcgagtcgtggggtctgaggccggactttgtggcgggtcattcgattggtgagatcgccgctgcgcatgtggcgggggtgttctcgctggaggacgcctgcaggttggtcgaggcgcgtgggcgtcttatgcaggcgctgcctggtggtggcgtgatgatcgcggtccaggcgtcggaggatgaagtcctgccgttgctgaccgatcgcgtgagcattgccgcgatcaatggtccgcagtcggtggtgatcgcgggtgacgaggccgacgcggtggccatcgcggagtccttcacgggccgcaagtcgaagcatctggcggtcagccacgcgttccattcgccgcacatggacggcatgttggaggacttccgggccgtggcggagggcctgtcgtacgaggctccgcgtattgcggtggtgtcgaatctgacgggtgcgttggtctccgacgagatgtcgtcggctgagttctgggtgcgtcatgtccgtgaggcggttcgcttcctggacggtattcgggctttggaggctgctggggttacgacgtatgtcgagcttggccctgggggtgtgctgtcggcgctggcgcaggagtgtgtcagtggggacggtgctgctttcgtgccggtgctgcgttctggacgttccgaggccgagaccgtggtgaccgcgctggctcaggcgcatgtgcggggtgtggaggtcgactgggcggcgttcttcgccgggaccggtgctgagcggatcgatctgccgacgtacgccttccagcgccagcgctactggccggagaccgtgctgtcgaccgtgggcccggtcgttgccgaggccgtcgatgcggtggacgcccggttctgggatgcggtggagcgggaggatctcgcgtcgcttgtcgcagagctggacgtggacgagacgcctctcggcgaggtcgttcccgcgctgtcggcgtggcgtcgggagcggcgtgcccagtcggaggtggacggttggcgctaccgggtgtcgtggaagccgctggctgatgcttcgacggcgcggttgtccggctcttgggtggtggtgtcgcccgataagggtgtggatgactcggctgtggtcgccggtctggctgggcgtggtgctgaggtccgtcgggttgtggtcgaggcgggtgtggaccgttcggcgctggctgggttgctggccgatgcgggttctgctgcgggtgtggtgtcgcttctcgggctggatgagtctgaggggctgctggggactgttggtttggtgcaggcgttgggtgatgccggggtggaggcgccgttgtggtgcctgacccgtggtgctgtctccgtcggtcgttcggatcggcttgtgtcgccggtgcaggcgcaggtgtggggtctgggccgggttgccgccctggaggttccggagcattggggcgggctggttgacctgccggaagtgctggatgagcgggctgtggcccgcttggtcggtgtgcttgcgggttccggcgaagatcaggtcgcggttcgttcgtctggtgtgttcggtcgtcgtttggtgcgtgcaccgcgggccgagggtgctgcggcgtggacaccgaccggcactgttcttgtcaccggtggtacgggtgtgctgggtggccgggtggcgcgttggctggcgggggcgggcgctgagcgtctggtgctgaccagtcgtcgtggtccggatgctccgggtgcggctgagctggtggaagagctgaccaccggcttcggggtggaggtttcgatcgtcgcgtgtgacgcggctgaccgtgacgccctgcgcgccctgctctccgctgaggccgggactctgaccgctgtgatccacacggccggtgtcctggacgacggcgtcctcgacgcactcaccccggaccgcatcgacagcgttctgcgcgccaaggccgtctcggcactcaacctgcacgaactgacggccgagcttgatatcgagctgtccgccttcgtcctcttctcgtcgatgagtggcacggtgggtgcggccggtcaggccaactacgcggccgccaacgccttcctggatgccctggccgagcagcggcgcgccgatggtctcgcggcgacctcgctcgcttggggtccgtgggcggaaggcggcatggccgccgatgcggcgctcgaagcccgtatgcgccgcggcggagtaccgcccatggacgcggagcttgccctttcggctcttcggcaggccatcggttccgccgatgccgctctgaccatcgtggacttcgactgggcacggttcgcgcccggcttcaccgccgtgcgagccggcaacctgctcgccgaactgcccgaggcggcggccgtcatgcgcggcccggagaacgcggacagccgcccggaacacgccgactcgtcgctcgccctgaggcttcagggcatggcccaggccgaccaggagcctttccttctggagctcgtgcgtgcacaggtcgccgaggtgctgggacactccggcgccgaggacatcgaggcgggacgcgcgttcagggagatcggcttcgactcgctgaccgccgtcgagctgcgcaaccgcctcggggcggctgccgagctgcggctcccggccacgctcgtctacgactacccgacaccggcggccctcgccgtccacctccgtaccgaactgctcggcaagcaggtcgtcgtgtccggtccggtctccaaggtcgttgacgacgatccgatcgcgatcgtctcgatgagctgccgcttccccggtggcgtgcggaccccggaagacctgtgggaactgctgtccaccggcggcgacgccatctcggatcttcccctggaccgtggctgggacatcgacgcgctgtacgacgccgatcccagcacacagggcacttcgtacgcccgcgcgggtggcttcctctacgacgccgccgacttcgacgcggacttcttcgggatctcgccgcgcgaggccctcgccatggacccccagcagcgactgctcctggagacgtcctgggaagccttcgagcgggcgggcatcgaccccgagacgctccggggcagccaggccggtgtcttcgtcggcaccaacggccaggactacctctccgtactgctggaggagcccgaaggcctcgaaggccacttgggcaccggcaacgcggcgagcgtcgtctccggtcggctctcgtacgtgttcggcctggagggtccggcggtcacggtcgacacggcgtgctcgtcctcgttggtcgccctgcactgggcgatccaggccctgcgcaacggcgaatgctcgctggcgctcgccggtggtgtgacggtgatgtcgaccccgggcaccttcatcgagttcagccgtcagcgtgggctcgcggaggacggccgtatcaaggcgttcgcggcggccgcggacggtacgggctggggcgagggcgtcggcatgctcctggtggagcggctgtccgacgccgagcggaacgggcacccggtcctggcgatcgtgcggggctcggcgatcaaccaggacggtgcgagcaacggcctcaccgcccccaatggcccctcgcagcagcgcgtgatccgtgcggcgctggcgagcgcgggtctgtccgccgccgacgtggacgcggtcgaggcgcacggcaccggtacgacgctgggcgacccgatcgaggcgcaggccctgctcgccacgtacgggcaggaccgcccggccgaccggcctctgcagctcggttccatcaagtccaacatcgggcacacgcaggccgcggccggtgtcgccggagtgatcaagatggtgctggccatggagcacggcgtgctcccgcagagcctccacatcgacgcaccgtcaccgcaggtcgactgggaagccggtgacatcgcgctgctcaccgagcagcggcagtggccggagaccggacgtccccgccgggcaggtgtgtcgtcgttcggcttcagtggcaccaacgctcacaccatcatcgagcaggcaccggcgtcgacggagaccgaccgggccgaatccggctcggtggaaccggacttcgttcccctgatgctctcggcgaagagcgacgtcgcactccgggcccaggccgcaagcctgcgcgcacggctgatcgccgcccccgacatgcgcctgtccgacgtcggctccacgctgacgaccggccgctcggcgttcgagcgccgggcggcgctggtggcagggggccgcgaggggctgctcgcggggcttgaggcactggcggacggcggttcggcggcagggctggtggaaggttcgccggtgagtggaaagctggcgttcctgttcacggggcaggggagtcagcgtctgggcatgggccgtgagctgtacgaggcgtatccggtgttcgcggatgcgctggatgcggtgtgtgtccgtcttgaactgcccttgatggatgtgctgttcggggcggatgcgggtctgctgaacgagaccgcgtacacccagccggcgctcttcgccgttgaggtggcgttgttccggctggtggagagctggggtctgaggccggacttcctggcgggtcattcgatcggtgagatcgcggccgcgcatgtggccggggtgctgtccctggacgatgcctgtgctctggtggaggctcgggggcggttgatgggtgcgctgcctgcgggtggcgtgatgatcgcggtgcaggcgtcggaggacgaggtcctgccgctgctgacggaccgcgtgagcattgccgcgatcaatggtcctcagtcggtggtgatcgcgggcgacgaagccgacgcggtcgcgatcgtggagtcgttcacggggcgtaagtcgaagcggctatcggtgagtcacgcgttccattcgccgcacatggacggcatgttggaggacttccgggtcgtggcggagggcctgtcgtacgacgccccgcgcatccccgtcgtctcgaacctcaccggcgctctggtcaccgacgagatgggttcggcggacttctgggtccggcacgtccgcgaggccgttcgcttcctggacggcatccgggccctggaggccgcgggcgtgacgacgtacgtcgaactcggccccgacggtgttctgtcggcgatggcccaggagtgtgtgaccgaaggtggagcggcgttcgttcccgtcctgcggaaggggcggcccgaggccgagacggtgatggccacccttggccaggcacacgtcaggggcgtcgcggtcgactggcattcggtctacgggaccggtgcccagcgggtcgatctgccgacctactccttccagcgacagcggtactggccggcggcgtcttcgacggcaggtggttcggtcgacaggagcgtcgatgcggtggacgcccggttctgggatgcggtggagcgggaggatctcgcgtcgctggccgcggagctggacctggacgacgacgctcccttcagtgaactggcccccgcgctgtcggcgtggcggcgggagcggcgtgccctgtcggaggtggatggctggcgctatcgggtgtcgtggaagccgctggcggatgtctcggcgtcggggttgtccggctcttgggtggtgatctcgcctgctgggggtgtggacgactcggctgtggtgggtgcgctggttgggcgtggtgctgaggtccgtcgggttgtggtcgaggcgggtgtggatcgttcggcgctggctgggttgctggccgatgcgggttctgctgcgggtgtggtgtcgcttctcgggctggatgagtctgaggggctgctggggactgttggtttggtgcaggcgttgggtgatgccggggtggaggcgccgttgtggtgcctgacccgtggtgctgtctccgtcggtcgttcggatcggcttgtgtcgccggttcaggcgcaggtgtggggtttggggcgggttgccgccctggaggtccccgagcgctggggcgggctcatcgatctgcctgaggtgctggatgagcgggctgtgtcccgtctggtcggtgtgctttcgggtggtggttctggtgaggatcaggttgcggttcgttcgtcgggtgtgttcggtcgtcgtctggtgcgtgcaccgcgggctgagggggcttcggcgtggtctccgaccggcacggttcttgtcaccggtggtacgggtgtgctgggtggccgggtggcgcgttggctggccggggcgggtgctgagcgtctggtgctgaccagtcgtcgtggtccggatgctccgggtgcggctgagctggtcgaggaactggccgggtcgggggtcgaggtttcggtcgtcgcgtgtgatgcggccgaccgtgacgctctgcgcgccctgctctccgccgaggccgggactctgaccgctgtgatccacacggccggagttctggacgacggcgtcctcgacgcgctcaccccggaccgcatcgacagcgttctgcgcgccaaggcagtctcggccatcaacctgcacgaactgacggccgagctcggcatcgaactctccgccttcgtcctcttctcctccgtcacaggcacctggggtacggcggggcaagccaactacgcggctgccaacgcctacctggatgctctggccgagcagcggcgcgccgacggcctcgcggcgacgtccatcgcgtggggtccgtgggccgagggcggcatggccgccgatgcggcactcgaagcccgtatgcgccgtggcggagtaccgcccatgaagggtgaggcagccgtcaacgcccttcagcgggcgttgaacgcgaacgacacggttgtcaccgtcgtggatgtggaatgggagcggttcgcacccggtttcaccgccgcacgggcaagcacgctcctcgccgaactgccagaggcccagcgggcacttgctccgcaggagggcgacgagggccaggacgacggcgctgtccacggtcgcggtggtcactcgcttgcggaacggctcgcggagctgtcggccgccgagcgcgaccggctgctgctcggcctcgtgcgcaaggaagtcgccgcggtactcggtcacgccggcgtggaaagcatcggtgcggcgcgcgcgttcaaggaactcggcttcgactcgctcacggccgtcgaactgcgcaaccggctcggcgcggtcaccgggcttcggctcccggccacgctgatctacgactaccccacgtccggggccttggcggaatacctgcggggcgagttgctcggtacgcaggccgtggtgtccggtccggtgtccaatgccgtcgccgtcgacgacgacccgatcgcgatcgtcgcgatgagctgccgcttccccggcggcgtacggaccccggaagacctgtggcaactgctggcgacgggacgcgacgccatcggcgagttcccggaagaccgtggctgggacgcggaggccctgttcgggccccagttcgagcaggacgccccgtatgcgcgtgagggcgggttcctctacgacgtcgccgacttcgatcccgccttcttcgggatctcgccgcgcgaggccctcgccatggacccgcagcagcgcctgctgctcgaaacctcctgggaagccttcgagcgggccgggatcgatccgctctcggtgcggggcagccaggccggtgtcttcgtcggcaccaacggccaggactacctctcgctcgtgctgaactccgcggacggcggcgacggcttcatgagcaccggaaactcggcgagtgtcgtctccggccgactttcctatgtgttcggcctggaaggccccgcggtcaccgtcgacaccgcgtgctcggcgtccctggtcgcgctgcatctcgcggtgcaggcgctgcgcaacggcgaatgctccctggcgctcgcgggcggtgtgacggtgatgtccacgcccggcgccttcgccgagttcagccgtcagcgggggctcgcggaggacggccgtatcaaggcgttcgcggcggccgcggacggtacgggctggggcgagggcgtgggcatgctcctggtggagcggctctccgacgcccgcaggaacggtcaccccgtcctggccctggtccggggctcggccgtcaaccaggacggcgcgagcaacgggctcacggctccgaacggcccctcgcagcagcgcgtcatccgtgccgctctcgcgagcgccggcctggcacccggcgacatcgacgcggtcgaggcacacggcaccggtaccaagctcggcgacccgatcgaggcgcaggccctgctcgccacgtacgggcaggaccgcccggccgaccggcccctgcagctcggttccatcaagtccaacatcgggcacacgcaggccgcggccggtgtcgccggtttgatgaagatggtcctcgccatgcagcacggggtgctgccgcagaccctgcacgtggacgagccgaccccccacgtcgactggtcggccggtgacatcgcgctgctgaccgagcggcgggagtggccggagacgggccgtccgcgccgggcgggcatctcctcgttcggtgtgagcggtacgaacgcgcacaccatcctggagcaggcaccgccgctcacggagaaggacgaggctgaggccgcgaggccggagaccggctccgccgtctcggcgtggcccctcgcgggcaagaccgaagccggcctgcgtgagcaggcggaacggctgctggcacacatcgatgcccactccgagctgcggccggtggacgtcggtcactcgctcgcgaccggccgggcggcgttcgaccaccgtgccgtgctcgtggcgggagacgaccggtcggagttccgacgggcactggccgcgctggcgtcgggagaatccgtcgcgcaggtggtacagggcatcgcgcgaccggatcagcaagtggcgttcctgttcacggggcaggggagccagcggctggggatggggcgtgagctgtacgagacgtatcccgtcttcgcggatgcgctggacgcggtgtgtgctcgccttgaactgccgctgaaggatgtgctgttcggaggggacgcggatcggctgaacgagaccgcgtacacccagccggctctcttcgcggtcgaggtggcgttgttccggctggtggagtcgtggggtgtgaggccggacttcctggccgggcattcgatcggtgagatcgcggccgcgcatgtggcgggggtgttctcgctggatgacgcctgtgctctggtggaggcgcgtgggcggttgatgcaggcgctgccgaccggtggcgtgatgatcgcggtccaggcgtcggaggccgaggttctgccgctgctgaccgagcgcgtgagcatcgccgcgatcaacggtccgcagtcggtcgtgatcgcgggtgacgaggccgacgcggtcgcgatcgtggacgcattcaacgaccgcaagtccaagcggctcgcggtcagtcacgcgttccactcgccgcacatggacggcatgctcgccgacttccgcaaggtggcggaggagctgtcgtacgaggctccgcgcatccccatcgtctcgaacctcacgggggccctggtcaccgacgagatggggtcggccgacttctgggtgcggcacgtccgcgaggccgtccgcttcctggacggcatccgggcccttgaggccgcgggggtcacggtgtacgtcgaactgggcccggacggagtcctgtcggctatggcccaggagtgcgtcaccggcgagggtgcggccttcgtgcccgctctccgcaagggtcgtcccgaggccgagacgatcacagcggccctcgcccacgcgcacacccacggcatcgccgtcgactggcaggcctacttcgccgggaccggcgcccagcgcgtcgacctcccgacctacgccttccagcgccagcgctactgggtggattccttcgccgagttcgacgatgtcgcctcggccgggatcggatcggccggtcatccactgctgggtgcggcggtcgagctgccggactcggacgggttcctgttcaccgggcggctctccctccgtacgcacccctggctcgccgatcacgtggtggcggacaccgttgtggtgccgggcgcggcgttcgtcgagctggcggtgcgcgccggggacgaggtcggatgcgaggaagtggaggagctggttcttgaggcgccgctcgtactgcccgagaagggggccgtgcagctgcggctcagcgtgggcggggcggacgaccagggacgccggtccgtacacgtgcacagccgcgttgaggcggccgatgggggcggggtccccggcggggcgtggtcccgcaatgcaacgggtctcctctccaccggcggtagcggaagcgacgtcgactccggcacggtcatcggtgagtggccgccggccggagccgagcaggtggatgtgaccgcggtacgcgaacgactggcggccgcggggctccaccacgggccgggcttccggacgctgaccgaggtgtgggtgcggggcgaggaggtgttcgcggaggctaggctctccgacgaactgagcgcgtccgcagggcggttcgccctgcacccgacgctgctcgacgccgcctcgcaggcgctggcggccggtacgaccgccgccgcatccggcatcggtggtgcgggacggctgcctcaggcatggcgcggggtacggctgcacgcggggggagcggacgctctgcgtctccggatcaccgcgggcggtcaggacaccgtttccgtcgtcctgaccgacacgcagggtgcgccggtcgcgacggtcggctcgctggtcacggaggcggtcgacgccgagcggtacgcggcggttccggacggatcccacgattcgctgttccgcctcgactgggtgcggacgacggctccggggcggccgacctccgcggacttcgcggtgctcggtacccccggcactggcatcggcgcccgcatcggcggtgacgagggcttcctcgtcggcgcgttggagcgggcgggtctgaccgccgagacgtacgacggtctcgcggcgctcgactcggccgtcgcggccgggatggcgatgccggaaacggtggtggtgtcattcgccgcagctttggacccggcctcggactcggccgcggacacggtggcctccgtcgactcggcggaggaggtcgcgcggctcgcccaggcggtgcgcgaggcgacgcaccgggcgctcgcgaccgtgcagggctggctggacaacggccggttcgccggagcgcgtctggtcgtcgtcacccgaggagcggtggccacgggcagggacaccgaggtggaggacctcgcccacgcaccggtgtggggtctgctgcgtgccgcacagaccgagcacccggaccggttcgtcctcgtcgacctcgacggggcggacgcctccgtccgggccctgccgggcgccatcgcctcgcaggagtccgaactggccgtacgtgacggtgtgttgtacgcgccgcgcctggtcagggtcggggcggaggcggtcacgggtgacaccggcggtcgccgcatcgatccgcggggcacggtcctgatcaccggggcgagcggcggactcgccgggctcttcgcccgccatctggtggcggagcacggcgtacggcatctgctgctcaccagccgcaggggcgccgccgccgaaggtgccgcccaactcgccgatgaactcgtcgcgttgggtgcgcaggtgacctgggcggcgtgcgacgtggccgaccgggacgcgctggccgcactgctggcgtccgtaccggccgaacagccgctgacggccgtcgtgcacaccgcggccgtcctggacgacggcgtcgtggacctgctcacccccgagcgggtggaccgggtgctgcggcccaaggcggaagcggcgctccacctccacgagctgaccaaggacctcgatctgtcggcgttcgtcctcttctccgccgccgccggcacgctcggcggcgcggggcaggccaactacgccgcggcgaacgtcttcctcgacgccctcgcccggcaccgcacggcccgtggtctcaccgcgctgtccctcgtctggggcatgtgggccgaggagcggggcatggcgggcaggctgacggaggcggagctgggcagggcgggccgcggcggtgtggcaccgctgtcggcgacggaggggctcgccctcttcgacgcggccctcgccgcggacgaggccgtgctcgtaccggtcaggatcgatgtcccgaccctgcgggcccgggcggcggacggcgggatccacccgatgttccgcggactggtacggactccggtgcgcaggtcggcgcagagcgcgggccgcgcggcgggcaccgtgcccacggacggcgcgggggagcggacgctggcccggcaactggccgagctgtccgtcgccgagcgggagcggaccgtactggacctggtacgcggccaggtggccgccgtactcgggtacgggtccgccgaacacatcggcggtgagcaggcgttcaaggaactcggcttcgactcgctgaccgcggtcgagctgcgcaaccgactcggcgcggccggcggtctgaggctgcccgccacgctgatctacgactacccgaacccggccgccctcgcccagcacctgctgagcgaggtggccccggacacggcggagcgcaagctctccgtactggaggaactcgaccggctggagagcaccttctcctcgctggctcccgcggaactgtccgcggccgccggtgacgaggcggcccacgcgcgggtcgcggtacgcctccagaccctgctggcccagtggaacgacgcccgtctggcagagggcgggagcggggcccacgcgatcgaagaggcgagcgacgacgagctgttcgccctcatcgacaagaagttcggacagggctgaacctcgcccaccgggcgcgccgccgggtcagtccccggcggcgccgcccacccctgaaacgagacccgagacattccgagtacgtgcgaataccgccacgatctcggccacgcgaataggtggaagcgccagtggcgaacgaagcaaagctccgcgagtacctcaagaaagtcacgaccgatctggacgaggcgtacggacgcctgcgggagatcgagagccaggcccacgagcccattgccatcacggcgatgagctgccggttcccgggaggcgtacggtctcccgaagagctgtgggaactgctccgcaccggcggggacgcactcaccgcgtttcccgcggaccgcggctgggacctcgacaacctgttctcggacgaccccgacgaccacaacacgtcggtcacccgtgagggcgggttcctcggcgaggcgtcctcgttcgacgccgcgttcttcgggatctcgccgcgcgaggccatggcgatggacccgcagcagcggctgctgctggagacctcgtgggaggcgttcgaacgggccgggatcgacccccaggcgctgcgcggcagccagtccggtgtgttcgtcgggatcaacgggtcggactacctgaccccgctgctggaagcggccgaggactacgcggggcacctggggaccggcaacgcctccagcgtgatgtcgggcaggctctcgtacacgttcggcctggagggcccggcggtcacggtcgacacggcgtgctccgcgtcgctggtcgccctgcacctggccgtgcaggcgctgcgggccggagagtgctcgctggccgtcgccggcggggtgcacgtcatgtccacgcccggactcttcgtcgaattcagcaagcagcgcggactgtccacggacggccgctgcaaggccttcgcggcgggcgccgacggattcggcccggcggaaggcgtgggcgtcctgctgctggagcggctctccgacgcccgcaagaacgggcgtccggtccttgcggtggtccgcggttcggcggtcaaccaggacggtgcgagcaacggtctgacggctccgaacggtccgtcgcagcagcgcgtcatccggcaggccctcgccaacgcacggctctccaccgaccaggtcgatgtcgtggaggcacacggcaccggcaccagcctcggcgacccgatcgaggcccaggcgctcatcgccacgtacggccaggaccgcccggccgatcaaccgctgctgctcgggtcggtcaagtccaacatcggtcacacccaggcggccgccggtgtggccggcgtgatcaagatggtgctggcgatgcagcacggcgtgcttccgcagagcctgcacatcgacgagccgtcgccccacgtggactgggagtccggcgcggtctcgctgctcacggaacagacggcctggcccgagacgacgcatccgcgtcgtgcgggtgtgtcgtcgttcgggttcagcgggacgaacgcgcatgtgatcgtcgagcaggctccggtggttgaggaggtggcgggggatccggccggtgtggtcgagggttcgggtcccggggtggtgccggtggtgccttgggtgttgtcgggcaagagtgcgggggcgttgcgggcgcaggcggagcggttgtccggattcctcgcgggtgcttcggctgtggatgtgccgtcggttgatgtggggtggtcgttggcgtcgtcgcgtgctgggctggaacaccgggctgtggtgctgggcgatcacgcggccggtgtggcggcggtggcgtcgggtgtgatggccgcgggtgtggtgacggggtcggttgtcggcgggaagaccgcgttcgtgttcccggggcagggctcgcagtgggtgggtatggcggtggggttgctggattcctcgccggtgttcgctgcgcgggtggaggagtgtgcgaaggcgttggagccgttcaccgactggtcgttggtggatgtgctgcggggtgtggagggtgcgccgtcgttggagcgggtggatgtggtccagcccgctctgttcgcggtgatggtgtcgttggcggaggtgtggcgagccgctggtgtgcgtcctggcgcggtgatcggtcattcgcagggtgagatcgctgccgcgtgtgtggcggggatcttgtcgcttgaggatgcggcgcgggtggttgcgttgcgtagtcaggcgatcggccgggtcctggcgggtctgggcgggatggtgtcggtgccgttgccggcgaaggctgtgcgggagctgatcgctccgtggggtgagggccggatctcggtggccgcggtgaacgggccgtcgtcggtggttgtttcgggtgaggccgcggccctggatgagctgctggtctcgtgcgagtcggagggtgtgcgggcgaagcggatcgcggtggattacgcgtcgcattcggctcaggtggagttgctgcgggaagagcttgctgagctgctggctccgattgttccgcgcgctgctgaggtgccgttcttgtcgacggtcaccggtgagtgggtgcgaggcccggagctggatggcgggtactggttccagaacctgcgtcggacggtggagttggaagaggcgacgcggacgttgctggagcagggcttcggtgtgttcgtcgagtcgagcccgcacccggtgttgagcgtgggcatgcaggagacggtcgaggacgcgggccgggaggcggctgttctgggctcgttgcgtcgtggtgaggggggtctggagcgtttctggctgtcgctgggtgaggcctgggtccgtggcgtgggtgtcgactggcatgccgtgttcgcgggcacgggtgcccagcgggttgacctgcccacctacgccttccagtcgcagcggttctggccggaggccgcgcccatcgaggctgtggcggtgtcggcggagagtgcgatcgatgcccggttctgggaggccgtcgagcgcgaggacctggaggcgctgaccgcggaactcgacatcgagggcgaccagccgctgaccgcactgctgcccgcgctgtcgtcgtggcgtcggcagagccgtgagcattcgacagtggacggctggcgctaccgcgtcacctggaagcggatcgctgagccttccccggcccgcctgtcgggtacgtggctggtcgtcgttcccgaggtcggcccggccgacgagtggacgggagccgtcctgcgcatgctcgccgagcgcggcgctgaggtccgtaccgtgaccgtcccggctgacggggcggaccgtgaccggctcgccgtcacgctgaaggccgagacgagcgaggtcgctccgagcggcgttctctccctcctcgccctcgccgccggtgcgggagccttcgccgccgaactcgccctgtgccaggcgctcggtgacgccgacgtggccgcacctctgtggtgcgtgacgcgtggcgctgtcgccaccggccgttccgagcaggtggccgaccccgcgcaggcgctcgtctggggtctcgggcgggtcgcctccatggagcaggggggcaggtggggaggcctgctcgaccttcccgccgatctcgacggccgtacgctcgaacgtctcgcgggtgtcctggccggtgatggttcggaggaccaggtggcgctgcgcgcctcgggtctcttcggtcggcgtctggtgcacgcacccctcgccgacaccgccgccgtgcaggagtggcgtccgcagggcacgaccctggtcacgggcggtacgggcgcgctgggcgcgcacgtggcccgctggctcgccgggaacggcgccgagcacctgctgctcaccagccgacggggccccgacgcgcccggagccgccgcactccgcgacgaactcaccgccctcggcacccaggtcaccatcgcgtcctgcgacatggccgaccgggacgccgtcaccgccctcatcgccgccatccccgccgaccagcccctcaccgcggtgatccatgccgcggcggtcgtggacgacggggtcatcgagacgctggccccggagcaggtggaggccgttctgcgggtcaaggtcgacgcgaccctcatcctccacgagctgacccgtggcctggacctgtcggcgttcgtcctcttctcctccttcgccgccaccttcggcgcccccggccagggcaaccaggcacccggaaacgcgtacctggacgccttcgccgagtaccgccgggggtcgggactgcccgccacctccatcgcctgggggccgtggggcagcgcggacggcgacgacagcgcggcgggcgaccggatgcgccgccacggcatcatcgtgatgtcgcccgaacggaccctcgtctccctccagcacgcgctggaccgtgacgagacgaccctgaccgtcgccgacatggactggaagcggttcaccctcgccttcaccgcggaccgggaccggccgctgctcctggagcttcccgaggcccggcgcatcatcgagagcgcggagcgggagtccgccgacgacctggccgggggagtgccgctcacgcagcagctcgccgggctgcccgaggtcgaacaggagcggctgctcctcgacctggtccgtacggccgtcgccgccgtcctcggccatgccgacctggccgccgtcgaggcgggccgggcgttcaaggagctcggcttcgactcgctcacctcggtcgaactgcgcaaccggctcggcgcggtcagcggtctgaagctgcccgccagcctggtcttcgaccacccgacccccgccgccgtcgcggccttcctacgcgccgggatcgtgcccgacgcggccgcgggcggcgcgccgctgctggaggagctcgacaagctcgaagccgtactggagcggggcaccgccgacaacgtcgtacgggcccgggtgaccatgcggctccagaagctcctggggaagtggaacgagagcgaggaccagtcgggcgccgaggtgtgggcggccgcggccaacggctccgggtcgggcatcggcgcggggtcggcggacggcgtgctggacgaggtcgagcagctccaggaggcgagcgacgaagagctgttcgccttcatcaacaagggactcggccgcgcctgaccgcaatggatgtggatattgacggcgtgccgttaattggccaggatagtcagcccccttgttaatttccacaaggctcactgccccctgtcacaccctcccacccaggggtgtgtagggggcagttaggggttgtcgggaagattgggcggcgaataacctgccgctgagcagtcgattcaggcaagaagtgaaccggctgcatacccgattcaattctcggctttatctgcacagttattccgatgccgtctgctgcaaatgggtggttgcgttaaatggcgaatgaagagacgctgcgggactacctgaagctggtgacggcggatctgcaccagacgcgacagcgtctgcgcgacgtcgaggcgaagaatcaggaccccatcgcgatcgtcggcatgggctgccgctatcccggcggtgtgacctcgcccgaggagctgtggcagctcgtcgtggacggtggggacgccatttccggcttccccgccgaccgcggctgggacatggagacggtctaccacccggatcccgagcaccccggcacgagctacgccaaccagggtggcttcgtccgggacttcgcccggttcgacccgtcgctcttcggcatctcgccgcgcgaggccctcgccatggacccgcagcagcggttgctcctggagacctcgtgggaggcgttcgagcgggccgggatcgacccgacgtcgatgcggggcaagcaggtcggtgtcttcgtcggcaccagcaaccacgactacctgtcggcgctgctgagttcctcggagaacgtggagggctacctcggcaccggcaacgcggcgagcgtcgcctcgggccggctctcgtacaccttcggcctcgaaggcccggccgtcaccgtcgacacggcctgctcgtcgtcctcggtagccctgcacctggccgtgcaggcgctgcgcaacggcgagtgctcgctcgccctcgcgggcggtgccacgctgatgtcggctcccggcacgttcatcgactacagcaagcagcgcggactggccaccgacggacgctgcaaggcgttctcgcccgacgccgacggcttcagcctcgccgagggcgtgggcatcctgctggtcgagcggctctccgacgcccgccgcaagggacatcccgtcctggccgtggtccgtggcaccgccgtcaaccaggacggcgccagcaacggcctgaccgcgcccaacggcccgtcccagcagcgcgtcatccttcaggcgctgtccaacgccaggctcacccccgaccaggtcgacgcggtcgaggcccacggcacgggcaccggcctcggtgacccgatcgaggcgcaggcgctcatcgccacctacggccaggaccgccccgacgggcggccgctgtggctgggttcgctcaagaccaacatcggacacgcacaggccgcggccggtgtcgcgggcgtcatcaagagcgtcatggcgatgcgccacggcgtgctgccgcgcaccctgcacgtggacgagccgacccccgaggtcgactggtcggcgggtgacgtctccctgctcaccgaagcgcggccctggcccctgggcgaccagccgcgccggatcggcgtctcgtcgttcggcatgagcggcaccaacgcccacatcatcctggagagcgcgcaggagtacgccgacggccggcaggccgacgccggtaccgcggggaacgaaccggccaccggccgtacgaacccgcccggcgccctccccgtcgtcctgtccggccggaccgagcccgccctgcgcgcccaggccgccgcgctgcacgcccacctcgcggcccaccccggcctcggcatcgccgacctcgccttctcccaggccctcacccgcgcagcgctggaccggcgtgcggccgtcgtcgccgacgaccgcgacgccctgctggccgggctcgcggcactggcggaaggacgccccagcgcggacgtggtcgaaggcagcgccacggacggaaagctggcgttcctcttcaccgggcaggggagccagcggcccggcatgggccgtgagctgtacgcgacgtatcccgtcttcgcgcaggctctggacgcggtgtgcgagcggctcgaactgccgctcaaggacgtgctgttcgggaccgacggcgccgccggcgccgcgctcgacgagaccgcgtacacccagcccgcgctgttcgcggtcgaggtggccctcttccggctcgtggagagctggggcctgaagcccgactacctggccgggcactcgatcggtgagatcgcggccgcgcacgtggccggagtgttctcgctggaggacgcctgcaccctggtcgaggcgcgtggccgtctgatgcaggcgctgccgaccggcggcgtgatgatcgcggtcgaggcgtcggaggacgaggtcctgccgctgctcaccgactgggtgagcatcgccgccgtcaacggcccccggtcggtcgtcgtcgccggtgatgaggacgctgcggtcgcgatcgcggaggccttcgcagcccagggccgcaagaccaagaagctgacggtcagccacgccttccactcgccgcacatggacggcatgctcgacgccttccgcacggtcgcccagggactctcgtacgggactcctcgcatcccggtcgtctcgaacctcaccggcgccctcgtcaccgacgagatgggctcggccgacttctgggtccggcacgtccgcgaagccgtccgcttcctcgacgggatccgctggctggagagccgcggggtcaccacctacatcgaactcggccccggcggcgtcctgtccgccctcggccaggactgccagaccgcgaccggcccccgcgcggccgccttcctccccgcgctgcgcaccggccgccccgaggcgtcgtcgctgaccgcggccgtggccggcgcccatgtccgcgggctctccccggactggaccgtccgcttcgccggcaccggcgcacagcgcgtcgagctgcccacctacgccttccagcgcgagctgtactggccccgcgaccccttcaccgacccggccgaatccgcccacggcggcgaactcggcgccaccgacgccaagttctgggaggtcgtcgacagcgaggacctcgccgcgctcgccgacaccctcggggtcggcggcgacgaacccctcagcagcgtgctgcccgcgctctccgcctggcaccgccgccaccgcgaccgcgacaccgtggacggctggcgctaccgcgtcacctggaagccgctgacggacaccacgcccgcgtccccctccgggcactggctcctggtcgtccccaccgagcacgccgacgccccttgggccgtcgccgccgagcgggcactgaccgcacgcggtgtcaccgtgagcaccgtcgtgctcgacgcgaccctcgacgaccgggccgccaccgcccggcggatcggcgaagccctcgctgcctccgccgccaccgactccgccccggcgggcgccgaaacgctcgccggcgtgttctcgctgctcgccctggaggagcggccgcaccccgcggacccggcactgtccgccgggctcgccgccacggtcgccctcatccaggcactcggcgacgcgggagtggaagccccgctgtgggccgccacctgcggcgcggtctccaccggccgcaccgaccggctctccagcaccgcccaggcgcaggtgtggggcctcggccgcaccgccgccctcgaactgcccgtgcgctggggcggtctcgtcgacctgcccgggacccccgacgagcgggccgcgggccggctcgccgacgtcctcggcggactcggcggacccggcgccgaggatcacctcgccgtacgctccaccggcgtcttcgtccgcaggctggcccgcgccacccgcgacgagcgccccaccaccgagtgggccaccaccggcacggctctcatcaccggcggcacgggcgcactcggccgccacgtcgcccgctggctcgcccggaccggggcgcagcacctgctcctggtcagcaggcgcggcccggaagccgagggagccgacgcgctcgccgccgaactgcgcgcactgggcgccgaggtcaccatcgccgcctgcgacgtcgccgaccgcgacgccgtcgcggccctgctcgccaccctcccggccgagcacccgctgaccaacgtcgtgcacgccgccggggtgctcgacgacggcgtcctggacgcccagaccccgcagcgcctcgcgggggtcctgcgccccaaggcccacgcggcgcaggtcctgcacgagctgacccgcgacctggacctctccgccttcgtcctcttctcgtccgtcgccgccgtcttcggcgccgccggtcaggccaactacgctgccgcgaacgcctccttggaggccctcgccgagcagcgccgcgccgacggcctgcccgccaccgtgctggcctggggcgcctgggccgaaggcggcatggccaccgacgaactcgtcgccgagcgcctgcggctggccggactgcccgccctcgcacccgaactcgccctgtccgcactgcacagggcgctcaccctggacgagaccgcctcgctcgtcgccgacatcgactgggagcgcctggcccccggcctcaccgccgtacgcccctgcccgctgatcgccgacctccccgaggccgtgcacgccctcgccggagccgaggcgtccaccgggcccggcgccgccgccgacacgttcgcgcggcagctggccgacgcccccgccggtgaacgcgaccagctcgccctggagttcgtacgcacccaggtcgcggccgtactcggttacgccggtcccgagtccgtcgacccgggcagcgccttccgggacctcggcttcgactcgctcaccgcggtggagatccgcaacctcctcacctcccggaccggcctgcgcctcccggcgacgctgatcttcgactaccccaactccctctccctggccgccttcctgcagggagaactgctcggcgcgcaggcgaccgaccccgcccgccacacccccgcgggccccggcaccgccaccgatgacgaccccatcgcgatcgtcgcgatgagctgccgcttccccggcggcgtacagagcccggaagacctctggcagctgctctccaccggccgtgacgcgatctcgggcttccccggcgaccgcggctgggacctcgacgggctgtacgaccccgagtccgccggggagaacaccagttacgtccgcgagggcggcttcctcgccggtgccaccgagttcgaccccgcgttcttcgggatctccccgcgcgaggccctcgccatggacccgcagcagcgcctgctgctcgaaacctcgtgggaggccttcgagcgcgccggaatcgaccccgccaccgtgcgcggcgaacagatcggcgtcttcaccggcaccaacggccaggactacctcaacgtcatcctggccgcacccgacggtgtcgaggggttcctgggcacgggcaacgcggcgagcgtggtctccggccgcgtctcctacgtcctcggcctggagggcccggccgtcacggtcgacacggcctgctcgtcctcgctggtcgccctgcactgggcgatccaggccctgcgccagggcgagtgcaccatggccctggccggcggcgtgaccgtcatgtccacgcccgcctccttcatcgacttcagccgtcagcgcggcctcgcggaagacggccgtatcaaggcgttcgccgcggccgcggacggtacgggctggggcgagggcgtcggcatcctcctcgtcgagaggctctccgacgcacagcgcaacggccatccggtcctggcgatcgtgcgcggctcggccatcaaccaggacggcgccagcaacggcctcacggcgcccaacggcccgtcccagcagcgcgtcatccgccaggccctcgccagcggcggactgacgacgatggacgtcgacgccgtcgaggcccacggcacgggtacgaagctcggcgacccgatcgaggcgcaggcactcctcgccacctacgggcaggaccggccggaaggccgtccgctgctcctcggctcgatcaagtcgaacctcgggcacacgcaggccgccgccggtgtcgccggtgtcatgaagatggtcctcgccatgcagcacggtgtgctgccgcagaccctgcacgtcgacgagccgaccccgcacgtggactggtcggcgggcgacgtcgccctgctggccgatgccgtggcgtggcccgagaccgggcgtccgcgccgggcgggcgtctcgtcgttcggcatcagcggcaccaacgcccacaccatcatcgaacaggccccggcagccgtggcgcccgtcccgcccgtcgccaccacgcccgcacgggccgacggaccgcagccgtggctcctctcggcgaagacccgcgacgcactccacgaccaggcgcgccgactgcacgcccacgcggagctgaacccggaactgagccccgccgacctcggactctccctggcggccggccgttcggcgttcgagcggcgcgcggccgtgatcgccgcagaccgtgacgggctgctggccggcctcgcggccctggcggacggcggcgcggcggcaggactggtggagggctcaccggtcgccggaaagctggcgttcctgttcaccgggcaggggagtcagcggctcgggatgggccgtgagctgtacgacacgtaccccgtcttcgcggacgcgctcgacgcggtctgcgcgcatgtggacgcgcacctcgaagtcccgctgaaggacgtcctgttcggggcggatacgggtctgctggaccagacggcttacacgcagcccgcgttgttcgcggttgaggtggcgttgttccggctggtggagagctggggtctgaggcccgacttcctggccggtcattcgatcggtgagatcgcggccgcgcatgtggcgggcgtcttctcgcttcaggacgccagcgaactggtcgtcgcccgtgggcggttgatgcaggcgctgccgaccggtggcgtgatgatcgccgtccaggcgtcggaggacgaagtcctgccgctgctgaccgaccgggtgagcattgccgcgatcaacggccctcagtcggtcgtcatcgcgggtgacgaggccgacgcggtcgcgatcgcggagtcgttcacggggcgcaagtccaagcgcctcacggtcagccacgcgttccattcgccgcacatggacggcatgctggaagacttccgggccgtggcggagggcctctcgtacgaggctccgcgcatccccgtcgtctcgaacctcaccggcgctctgatctcggacgagatgggctcggccgagttctgggtccggcacgtccgtgaggccgtccgcttcctcgacggcatccgcacgctggaagccgcaggcgtcaccaagtacgtcgaactcggccccgacggcgtcctgtcagccatggcccaggactgcgtgagcggcgagggctccgtcttcatccccgtactccgcaaggcgcgccccgagcccgagagcgtcaccaccgccctcaccacggcccacgtccacggcatccccgtcgactggcaggcgttcttcgccgggaccggcgcccggcgcgtcgacctccccacctacgccttccagcgccagcgctactggcccgccgtctcctccctctacctcggcgacgtcgaggcgatcgggctcgacgacaccgcgcacccgctgctcagtgcgggtgtcgccctgcccgagtccgacggcatggtgttcgccgggcggctcgcgctctccacccacgcctggctcgccgaccacgccatcctcggcagcgtcctgctgcccggtacggccttcgtcgagctggccacccgcgccggcgaccaggtcggctgcgattacctggaagagctgaccctcgaagcgcccctcgtcctgcccgagcacggcggcgtccagctgcgcgtgtgggtcggcgccgccgacgagtccggccgacggccgttcgccctgcactcccgggccgaaggcctgccggtcgaggagccgtggacgcggcacgccggcggtgtactcgccgaaggcgggcggcccccggccgacttcgacctgacggcctggcccccgccgggcgccgtcgaagtggaccttgacgggcgctacgaccagctcgacggcatcggcttcgcctatggccccaccttccgtggcctgcgtacggcctggcagctcgacggcgagatctacgccgaggtcaggctgcccgagggagccgagggcgaggcgggccggttcggcctgcacccggccctgctcgacgcggcactgcacgccatcgggctgggcggcctcggcgccgacgacggccaggggaggctccccttcgcctggagcggagtatcgctgcacgcgggcggggctgccgcactgcgcgtccacctcgctccggcgggcgccgagggcgtccgcctggagatcgcggacgcctcgggcgcaccggtcgcggccgtcgagtcgctcgggctgcgcccggtgacggccgagcagctccgtgccgctcgtgccacctaccacgagtccgtgttccgtcagcagtggaccgagctgccgggtctcggcgctccggccgcgacccccgccgtccggtacgcgttcctcggcggcgacagcggcgacagcggcgacagcggtgacaccgcagccgccgaccgtcaccaggacctggcggcgctcgccgccgcgatcgacgccggaaggcccgtaccggacgaggtggtcgtcgaactcgccgccgcgccctgggccgtgtcggcgtcggccgtgcacagtgccgcgcacgatgcgctggcactcatccagacctggctcgcggacgaccggttcgccgccgcacgcctggtgttcctcacccgcggcgcggtggccgcggacgcgggcgacgacgtgaccgatctcgccgccgccaccgtgtggggcctgctgcggtccgcgcagacggagaaccccggcaggatcgccctcgtcgacaccgacggccacgaccggagcgagcaggccctgcgggcggcgctcacctccgacgaggagcggttcgcgctgcgcgccggagcggtcctcgtgccccggctcgcccgggtcgagatccagcaggacgactccgcccggacaccggccctcacgcccggcggcacggtactgatcaccggagccaccggagcgctgggcggtctcttcgcccggcacctcgccgccgaacacggcgtggagcggctgctcctcgtcggcaggcgcggggccgacgcccccggcgcggccgaactcgtcgccgaactcgccgagtcgggcaccctcgccacctgggcggcgtgcgacgtggccgaccgggacgcgctcgcggcactgctcgcggacattcccgccgagcacccgctgaccgccgtcgtccacacggccggagtcctcgacgacggcgtcatctcctcgctgacgcccgagcggctctccgccgtgctgcggcccaaggtggacgcggcctggaacctgcacgagctgacccggggcctcgacctcgccgccttcgtgctcttctcctccacctccggcctcttcggcggccccggacagggcaactacgccgccgccaactccttcctggacgccctcgcccagcaccgccgcgctcacgggctccccgcgacctcgacggcctggggcctgtggtccgtggccgacggcatggcgggcgccctggacgcggccgacgtcaaccgcatgcggcgggccggactgccgccgctgaccgccgccgacggcctcggcctgttcgacacggcggtctccctcgacgaggcctccctggccctgatgcgggtggacaccgaagtcctgcgcacccaggccggggccggtaccatcgcgccgctgctgcgcggtctcgtacggggcgtggcccgccggtcggtcgacgtgtcggccggtgccgggggcgccgaatcggagctgcgcggcaggctggcggcgctcaccgccgccgagcaggaccgggcgctgctggacctggtgcgtacgcaggtcgcggcggtcctcggacacgccggacccgcggccgtggagtcgggacgggccttcaaggaactcggtttcgactcgctcaccgcggtggagctgcgcaaccggctgaacgccgccaccgcgctgcgcctgcccgcgacgctgatcttcgactatccggacccgaccgttctcgcccggtacctgcgcggcgagctgatcggtgacgacaccacggacgccgtggccgagccgctcacggccgtggccgacgacgagcccatcgccatcgtcgccatgagctgccgctaccccggtgacgtacgcacccccgaggacctgtggcagctgctgacggcgggcgccgacggcatcacccggctccccgagaaccggggctgggacaccgagggcctgtacgacccggacccggagagccagggcacctcgtacgcccgcgacggcggattcctgcacgacgcggccgagttcgacgcctccttcttcgggatctcgccgcgcgaggccctcgccatggacccgcagcagcgcctcctcctggagacgacctgggaggtcttcgaacgggccggcatcgcgccgtccgcggtgcgcggcagccggacgggtgtcttcgcgggtgtcatgtaccacgactacggcgcgcgcctgcacgccgtgcccgacggcgtcgagggctacctcggcaccggcagctccagcagcatcgtgtcgggccgggtcgcctacaccttcggcctggagggcccggcggtcaccgtcgacacggcctgctcctcgtcgctggtcgccctgcacctcgcggcccaggcgctgcgcaacggcgagtgctcgctcgctctcgcgggcggtgtcaccgtgatgttcacgcccggaaccttcatcgagttcagccgtcagcgcggcctggccgccgacggacgctgcaagtccttcgcggccgccgccgacggcacgggctggggcgagggcgcgggcatgctcctgctggagcggctctccgacgcgcgacgcaacggccaccaggtcctcgcggtcgtccgcggctcggccgtcaaccaggacggcgccagcaacggcctcaccgccccgaacggcccctcgcagcagcgcgtcatccggcaggccctcgccaacgccggtgtcgccgccggacacgtcgacgccgtcgaggcacacggcaccggcaccaccctcggtgaccccatcgaggcgcaggccctgctcgcgacctacggccaggagcacaccgacgaccggccgctgctcctcggctcggtgaagtccaacctcggtcacacacaggccgcttcgggcgtcgccggtgtcatcaagatggtcatgtcgatgcggcacggtgtgctgccgaagaccctgcacgtcgacgagccgaccccgcacgtggactggtcggcgggcgcggtctcgctcctcaccgagcagaccccgtggcccgagaccggccgtccgcgccgcgcgggcgtctcctccttcggcatcagcggcaccaacgcgcacgccatcatcgagcaggccccggagccggacccggcccgggcgaaggcgacggcgcggcccgcgccggacgccgcggcgccgtcgtccgtgcccctgatcgtgtccgcccgcggcgaggacgcgctgcgcgcccaggcccgcaggctccacgcccacgtccacgccgaccccggcctgcgcgccgtcgacctcggcctctccctggcgaccacccgctcggccctggagcagcgcgcggcgctggtggccggcgaccgcgcggaactgctgcgcggcctggacgccctggcccgcggcgaggacaccgcggggctggtgcgcggcaccgcccgcgagggccaggtggcgttcctgttcaccggtcagggcagccagcggccggggatgggacgcgagctgtacgacgcgcatcccgtcttcgcggacgcgctcgacgagatctgcggcgaactggaccggcacctcgaagtaccgctcaagggcgtgctgttcgcgaccgagggcgatctgatccaccagaccgcgtacacgcagcccgcgctgttcgccgtggaggtggccctgttccggctcctggagagccggggcgtgcagcccgacttcctggccggtcactcgatcggtgagatcgccgcagcccatgtggcgggcgtcttctcgctccaggacgccagtgaactggtcgccgcccgtgggcggttgatgcaggcgctgccgaccggtggcgtgatgatcgccgtccaggcatcggaggacgaggtcctgccgctgctgacggaccgggtgagcatcgccgcgatcaacggcccccagtcggtcgtgatcgcgggcgacgaggccgacgcggtggccatcgccgagtccttcacggaccgcaagtccaagcggctcacggtcagtcacgccttccactcgccgcacatggacggcatgctcgccgacttccgcaaggtcgccgagggcctcgtctacgagaacccgcgcatcccggtcgtctcgaacctcacgggggccctggtcaccgacgagatgggttcggccgacttctgggtccggcacgtccgcgaggccgtccgcttcctcgacggcatccgcgccctggaagccgcgggcgtcaccacacacatcgagctgggccccgacggcgtgctctgcgccatggcccaggaatgcgtgagcggcgaggacaccgtcttcgtccccgtactgcgccccggccgccccgaggccgagaccgtcaccaccgccctcgcccgcgtccacgtccagggcgtacccgtggactggcaggcgtacttctccggcaccggcgcccagcgcgtcgacctgcccacctacgccttccagcgcaagcgctactggctcgacgtcggcgtctccgtcgaggacgtgctggcggccggtctcgatgcggccgaccaccccctgctgggcgccaccgtctccctgcccggatccgacgggctggtcctcaccggacgcctcgcgctgtccacgcacccctggctgagcgaccacaccgtcatggacaccgtcctgctgcccggcacggccttcgtcgaactcgccctgcgggccggtgaactggtcggctgcggcgccgtcgaagagctggcgctcgaagccccgctcaccctcgccgaccagggcgccgtccagttccagctggccgtggacgcgccggacggcgccgggcgccggaccctgaccctgcactcccgccgcgcgggtgccccggccgaagagccgtggacacggcacgccaccggcgttctcacgcccgaagcgtccgccgtgcccgcgcaccccttcgacctgaccgcatggccgccggccgacgcggagcccgtgcccaccgacgccttctaccccggcgcggccgcggccggcctcggctacggaccggtcttccaggggctgcgggccgcctggcggcgcggcgacgaactgttcgccgaggtcgcactcgacgaggagcacgaggccgacgccgccgcctacgggctgcaccccgccctgctcgacgcggccctgcacgccatcggcctcggagcgcccggcgcgcccgccgacgccccggccgaaggagcccggctgcccttcgcctggaccggcgtacgcctgtacgcggccggcgcggcgggcatccgcgtccggctgaccgccgccgcatccggcggcatcgccctggacgtggccgactccaccggagcgccggtggcctccgtcgagtccctgatcctgcgccccgtctccgcggagcagctcggcggggaccgcacggcccaccacgagtcgctcttcggcgtcgagtggaccaggctgtccctccccaccggtgcgatcccctccggcgaacgctgggccgtactcggcgaggacgagccggacctccgggtcggcggcgaacgcctcgacgtgtacagcggtctcacggcgctgcgcgaggaaatcgccgcgggcacctcggcgccggacgtcgtcgtcgtacccctgtcctccgccgcgtccggtggcggacgtgcggggaccgcccgggccgccgcgcaccacgcgctggccctggtcaaggagtggctggccgacgaacggctcgacggcgcacggctcgtgctgctgacccggggcgcggtggccgccgtacccgacgagcacgtgaccgatctgacccacgccccggtgtggggcctcgtacggtccgcgcagtcggagaaccccggccggttcgtgctcgccgacaccgacggcgccgacgcctccttcggggcgctggccgccgcgctcgccaccgacgagccgcagctcgccctgcggtccggcgaggcacacgccttccggctgcgccgcatcgcccgtaccgcgagcgatccggccggtgaaaccggcacgggcgacggccccacccgtgccgacgacgccgggaggatcgccgccgacggcacggtcctggtcaccggcgcgagcggcaccctcggcgggctcttcgcccgccacctggccaccacgcacggcgcacggcacctgctgctgctgagccgtcgcggggaccgggcccccggggccggggaactgacccgtgagctgaccgaagcgggcgtggacgtgacctgggcggcgtgcgacgcggccgaccgggacgcgctcgccgccgtactcgccgcgatcccggccgaccggccgctgacggcggtcgtccacaccgccggtgtgctcgacgacggcatcatcgactccctcacacccgaacgcctcgacaccgtgctgcggcccaaggtcgacgcggcctggaacctgcacgagctgaccgagggccacgaactctccgccttcgtgctcttctcctcggtcgccggctgcttcggcgccgcgggccagggcaactacgcggcggccaacaccttcctggacgccctcgcccagcaccgcaaggcccggggcctcaccgccagttccctcgcctggggcctgtgggagacgacggacggcatggccggcgcgctcgacgaagccgacctgacccgcatggcccgctccggtgtggccgcgctcgcccccgacgagggcctggccctcttcgacacctcccgcaccctggacgacgcggtcctcgtccccatgcggatcgaactgggcgcgctgcgcgcccaggccgcggacggcaccctgccgccgctgctgcgcggactggtgcgcactcccgcgcgccgggccgccggctccacggcacgcgccggaacgcgccccggcaccgacccggcgggcaccctcgaagagcgcctcgccggactgtcggccgccgaacgcgaccgggccctcatggagctggtccgcacacaggtggccgcggtcctgggctacgcgggccccgacgacgtcgacgccgcacggggcttcctcgacctgggcttcgactcgctcacggccgtcgacctgcgcaaccgcctcacggcgagcgccggactccggctgcccgtcacgctcatcttcgactacccgtctccgaccgcgctcgccgcgtacctcgccgaacgcctcggccagggcgacccgtcccgccggcccgtccacgcggaactcgacaagctcgaatcgatcctctcgacggtcggccccgacgacgtcgaacgcgcgggcatcaccgcccggctgcgagaccttctggcgaagtggaatgaaacgcacagtgcacaggacagcgccgcagacgagcgggaaatccagtccgcgacggccgacgagatcttcgatctcctcgacgacgaactcgggctgtcctgaccggctcctgcccggcgggcggccggccggtgcggagcaccggctcccggccgcccgcccgtccggcacccaccttccgatccaccggctccgcgcgagctttccgactctgaccacggggatggcgtaaatggtgaacgaggagaagtacctcgattacctcaagcgggcgactaccgacctccgcgaggcacgacgacggctgcgcgaggtggaggaacgggagcaggagccgatcgccgtcgtggcgatgagctgccgctaccccggggggatcgacacccccgagaagctgtgggacctcgtcgcccacggccgggacgccgtctccgcctaccccacggaccgcggctgggacgccgaagtcctcttcgaccccgaccccgagaccgggatcgaggcgtacgaacaggtcggcggcttcctgcacgacgcggccgacttcgaccccgcgttcttcgggatctcgccgcgcgaagccctcgccatggacccccagcagcggctgctgctggaaacctcctgggaggcgttcgagcgggccggaatcgacccggcgaccctgcgcggcagccgtacgggcgtcttcgccggcctgatgtaccacgactacgccgcccggctgttcagcgtgcccgaggagatcgagggcttcctcggcaacggcagctccggcagcatcgcctcgggccggatcgcctacaccctcggcctcgaaggccccgccgtcaccgtcgacacggcctgctcctcctcactggtcgccgtgcacctcgcggcccaggcactgcgcaacggcgagtgcacgctcgccctcgccggtggtgtcaccgtcatgtcgacccccggcaccttcaccgagttcagccgccagcgcggcctggcggccgacggccgctgcaagtccttcgcggccgcggcggacggtacgggctggggcgaaggcgccggcatgctcgtcctggaacggctctccgaagcccgcaggaacggccaccccgtcctggcactcgtgcgcggttcggccgtcaaccaggacggcgccagcagcggtctgacggcccccaacgggccgtcccagcagcgcgtcatccgccaggcactcgccggtgcgcggctgtcggccacccaggtcgacgcggtcgaggcccacggcaccggcaccaccctcggcgacccgatcgaagcgcaggccctgctcgccacctacggccaggaccgtcccgacggccgcccgctgtggctgggctccatcaaatcgaacatgggtcacacccaggccgccgccggtatcgcgggcattatcaagatggtcatggcgatgcgccacggcatcctccccaagaccctgcacgtcgacgagccgaccccgaacgtcgactggtccgagggcgcggtctccctgctcaccgagtccgtgccgtggcccgagaccggcgcgccccgccgcgcgggagtctcgtcgttcggcatcagcggcaccaacgcccacaccatcctcgaacaggccccggacgccgtcgaggccgcacccgggaccgagccccccgcggcggccgcaccgcccgtgcccccgctctggaccctctccgccaagagcccggccgcgctgcgcgcccaggccgggaaactgcacgcccacctgaccgcacaccccggcctgcgccccggggacatcgcccactcgctcgccgtcggacgcaccgacttcgagcaccgcgccgtcctcacctccgccgacgggcccgtgggcctcgtccgtgcgctggaagccctcgcggactcggctcccgaggacacggcacccgccgacagggcaccgggggtcacccggggccgcccggtcgccgggaagctggcgttcctgttcaccgggcaggggagccagcggctggggatgggccgcgagctgtacgagacgtatcccgtcttcgcgcaggctttggacgcggtgtgtgagcggctgaatctcgaagtgccgctgagggatgtcctgttcggggcggatgcgggtctgctggaccagacggtctacacgcagaccgcgttgttcgcggtcgaggtggcgttgttccggctggtggagagctggggtctgaagcccgacttcctggcgggtcattcgatcggtgagatcgcggccgcgcatgtggcgggggtgttctcgctggaggatgcgtgcgcgctggtgtcggcgcgtggccgcttgatgggtgcgctgccgggtggcggcgtgatgatcgccgtccaggcgtcggaggacgaggtcctgccgctgctcaccgaccgcgtgagcattgccgcgatcaacggtccgcagtcggtcgtgatcgcgggcgacgaggccgacgcggtggcgatcgccgagtccttcgcggaccgcaagtccaagcggctcacggtcagtcacgccttccattcgccgcacatggacgccatgctggaggacttccgggccgtggcggagggcctgtcgtacgaggccccgcgcatccccgtcgtctccaacctcaccggcgccctcgtctccgacgagatgggctcggccgacttctgggtccgccacgtccgcgagaccgtccgcttcctcgacggcatccgcgccctcaccgagcgcaacgtcgtccacttcgtcgaactcggcccggacgccgtgctgtcggccatggcccaggactgcccctccgccgacaccgcggccttcgtgcccgtactccgcaagggccgttcggagaccggttcgctgaccgacgccctcgcgcggctccatgtgggcggggtggccgtcgactgggacgcgtactactccggtacggacgtccagcgcgtcgacctgcccacctacgccttccagcgcgcgcactactggctcgacgcaggccggcccctcggcgacgtctcctcggccgggctcggtgcggccggccacccgctgctcggggccgccgtggccctcgccgacctcgacggtttcctctacaccggccgtctctcgctcgacacccacccctggctcgccgaccacgccgtcatgggttcggccgtactgccgggcaccgccttcgtcgaactggccatccgcgccggtgaccaggtcggctgcgacctgctcgaagaactcaccctgcacgcaccgctcgtactgcccccggccggaggtgtgcaggtccagttgtgggtcggcgcaccggacgccaccggccgccgcaccctgggtgtgcactcccgccccgagcccgcaccggacgccgtcggcccggacgccgacgcggcggagccgtggacccggcacgccgacggtgtgctcgccacgggtgccccgcagccgtccttcgcccccgacgtctggccgccggccggtgccaggcccctgcccgtcgacgagctgtacgccgggctcgccgaggcgggcctcgaatacggccccgccttccagggcgtccgcgcggcctgggcgagcgacgacgcggcctacgtcgagatcgcggccgccgacggacagtgggccgatgccccgctgttcggactgcatcccgcgctcctcgactcggcgctgcacgccatcggtctggccgggctcgtcgaggacaccggccgcggccggctgcccttctcctggtccggggtgtccctgtacgccgtgggcgcctcggtgctgcgcgtacggctggccaaggccggaccggacgcggtgtccctggccctcgccgacggcgccggacagcccgtgggcgacatcgcctcgctcaccctgcgccctgtctcggccgagcagctggacaccgggcggggcggtcaccatgacgcgctgttccaggtggactggaccccgctgaacctgccccgtgctgtcgacagccgctgggccgtgctcggcgagcccgtccccaccgacgagccgggcgacggcgtggcgcgccacgcggacgcggaggcgctgagcgcggccctcgacgcgggtgctccggtgccggatgccgtactcgtacgccaccccgccctgcccgaacccacccccgaggcggtccaccaggccgcgcaccggaccctcggcctgctgcggcactggctcggcgacgaccggctcgccgacagccgcctcgtcctgctcacgcacggcgcggtcgccgcgggagacgcggaccaggtacccgacccggtgcacgccgtggtctgggggctggtccgctccgcacagtccgagcacccgggccggttcctgctgatcgacagcgattccggtatcgacacactctcctggccgacgttcggtgccgttctcgcctccgaggagccgcaggtcgccctgcgcggcggcgtggcccacgcacccaggctggccaaggttcccgccaccgctaccgccgctgccgtcgtcgagacgtcgtcgtacgaccctgacggcaccgtcctcgtcaccggggccagcggcacgctcggcggactcgtcgcccgtcacctcgtgaccgggcgcggcgtacggcgtctgctgctgctgagccgtcggggcgccgatgcccccggtgccggtgaactggccgctgagctgaccgggttgggtgccgaggtgtcgtgggcggcgtgtgacgcgggtgaccgcgacgcgctcgcggccgtactggccgccgttcccgcagcgcacccgctcaccgcggtcgtccacacggccggtgtcctcgacgacggcgtgatcggttcgctcaccccggagcgcctcgacacggtccttcgcccgaaggccgacgccgctctccacctgcacgaactgacccgcgacctgcccctgaccgccttcgtcctcttctcctccgcggccggggtcttcggcgcaccgggtcagggcaactacgccgccgccaactccttcctggacgccctcgcccagtaccggcgtgcccacgggctccccggccggtcgctggcctggggcctctgggaggacgccgaaggcatggcgggcgccctcgaccgcgccgacctcgaccggatgaagcgcggcggagtccacggactcaccgcctccgagggcctcgcgctcctcgacctcgccgacgccctcggcgcggaccgtgacgaccagggccaggatcaggagacggccggacgggcgctgctcgtgccgatgcggctgacccttcccgccgtcgcccccggcgccgaagtcgccccgctgttccggggattggtccgcacccccgcgagacgcgtcgcggccggagccaccacgggagccaccaccggaaccgggcccgacctctccgctctcgaacggcggctcctcggcctcgacgcgccggagcgggagcggctgctcctcgacctcgtccgcggccatgtcgccgacgtgctcggccacggctccccggacgccatcgaccccgaacaggccttcagcgagctgggcttcgactccctgacggcggtggaactgcgcaaccgcctgggcgcggccatcggccggcggctgcccgccacgctgatcttcgaccacccggcctcgctcaccctcgcccgtcacctctccggtgaactcgccgggtcccaggccgcgttggcgccagccgggcccgcgcccaccgtgaccgacgacgacccgatcgccatcgtggcgatgagctgccgctaccccggcggcgtgaccacccccgaggagctgtggcagctcctcgcgggcggcggggacgcgatatccggcttccccgccgaccgcggctgggacgtcgagtcgctgtacgaccccgatcccgaccacccgggcacctcgtacacccgccacggcggcttcctgcgcgacgccgccgcgttcgatccgacgttcttcgggatcagcccgcgcgaggccgtcgggacggacccgcagcagcggctcctcctggagaccacctgggaggcgttcgaacgggccgggatcgacccggccaccgtgcgcggcagccggaccggtgtgttcgcgggcgtcatgtaccacgactacgcggccctgctggagcgctcgaaggacggagcggacggctccctcggctcgggcagcaccggcagcatcgcctcgggccgggtctcgtacaccttcggtctcgaaggccccgccgtcacgatcgacaccgcctgctcgtcgtcgctcgtggccctgcacatggccatccaggcgctgcgcaccggcgagtgcgacatggcgctggccggcggtgtcaccgtcatggcgacccccggcacgttcatcggcttcagccgtcagcgcggcctgtccgccgacggccgctgccgcgccttctcggccgacgccgacggtacgggctggggcgagggcgtcggcatgctcctcgtggaacgcctgtccgacgcccgccgcaacgggcatccggtcctggccgtggtccgtggctcggcgatcaaccaggacggcgcgagcaacggcctcaccgcccccaacggcccctcgcagcagcgcgtgatccgcgcggccctcgcgagcgcgggcctgtcggccgccgaggtcgacgcggtcgaggcgcacggcaccggtacgacgctcggcgatccgatcgaggcgcaggcgctcctggccacctacggccgggagcacaccgaggacagcccgctgtggctcggctcgatcaagtccaacatgggtcacacgcaggcggccgccggtgtcgcgggcgtcatcaagatggtcctcgccatccagcacggcgtgctgccgcgcaccctgcacgcggaccggccctcgccccacgtggactggtcgcagggcgccgtctcgctgctcaccgagtccgtcccgtggccggagacgggccgtccgcgccgcgcgggcgtgtcgtcgttcggcatcagcggcaccaacgcgcacacgatcatcgagcaggcgccggaggaggccacggtggccccggccgacgcggtggccgcgccgagcgcgctgcccctgcagctcgcgggccgcagcgccgaggcgctctccgcccaggcccgtgcgctgagcgcacacctgaccgcacaccccgacgtccccctcgcagacctcgcctactccctggccacgagccgtgccaccttcgaccaccgggcggtcctggtcgcgacggagggcacaacggccgccacggccgtcacggcgctcgacgccctcgccgaccggcgcacggcaccgggcctggtgcggggcacggccagcaagggcggtcgcacggcgttcctgttcacggggcaggggagccagcggctggggatggggcgtgagctgtacgaggcgcatcccgtcttcgcgcgggctctcgacgcggtgtgtgatcgcctggaactgccgctgaaggatgtgctgttcggtactgacgcgggtctgctgaacgagaccgtgtacacgcagccgggtctcttcgccgtcgaggtggcgctgttccgtctgctggagagctggggtgtgaagcccgacttcctggccgggcactcgatcggtgagatcgccgcagcccatgtggccggggtgctctccctcgatgacgtgtgcgctctggtggaggcgcgtgggcggttgatgggtgcgctgccgggcggtggcgtgatgatcgccgtccaggcgtctgaggctgaggtcctgccgctgctgaccgaccgggtgagcattgccgcgatcaacggcccccggtcggtcgtcatcgcgggcgacgaggccgacgcggtcgcgatcgtggagtccttcacggaccgcaagtcgaagcggctcacggtcagtcacgccttccactcgccgcacatggacggcatgctcgacgccttccgtgaaatcgcggagggtctgtcgtacgaggctccgcgcatcccggtcgtctccaacctcaccggggccctggtctcggatgagatgggttcggcggacttctgggtgcggcacgtccgtgaggccgttcgtttcctggatggcatccacgccctggaggccgcgggcgtgacgacgtacgtcgaactcggccccgacggagtcctgtcggcgatggctcaggagtgcgtgaccggcgaggactccgtcttcgtgccggtcctgcgctcgggtcgtcccgaggccgagagcgtcaccacggccctcgcccaggcgcatgtccgcgggatcgccgtcgactggcaggcgtacttcgccgggaccagtgcccagcgcgtcgacctgcccacctaccgcttccagcgcgagcactactggcccgagacgggcatccccctgcccggcgacaccgctgggctcgggctcgccgccgcgggtcatccgctgctgggtgcggccgtgacactcgcggacgccgacggatgcgtcctcaccggtcggctctccctgcggacgcatccctggctcgcggaccacgccgtcatggggtccgtactgctcccgggaacggctctcgtcgaactggccctgcatgcgggcgagcgcgtcggaacccgtgccctggacgagctgacgcttcaggccccgctgatcctgccgaacgagggcgcggttcagctgcaagtcgtggtcggtgcgcccgatgccgcgggccaccgcacggtggccgtgtactcccgcccggacgccgacggcgaagcgtgggtccggcacgccgacggactgctggtggacgaggtccggggcgccgccgccgacctcggcgtctggcccccggccggtgcgaccgccgttccggtggacgacgcctacgcgatcttggagacctcggggctcgcgtacggccccctgttccaggggctgcgggcggcctggcggcgagcaggagagctgttcgcggaactggccctgcccacggaggcgcaggcggacgccgccgcgttcgggctgcaccctgcgctgctggactcggcgctgcacaccctggcgctgggtgatctgctgtccggcgcggacgcggaggaaacgcccggcgccgcacggctgccgttcgcctggcgtggtgtccgcctccacgcggccggtgccccggcggtacgggtccggctggccgaggccggtcagggcgcggtgtcgctggaactggccgactccgcgggtgcccccgtcgcctcggtggattccctggtactgcgggcgatgtcgcccgagcagctcggcgcggcgagcgccggccgccaggagtcgttgttccagatcgactgggtggagccggcggccgaccggacggcggctgcgaccgatgtcgaacgggccctggtgggcccggagctgcggggtctggacgccacgccgtacgccgacctggccgcgctggcggccgcggactccgacgtgcccgaactcgtgttcatcaccacgcgagcggagtcggagccggagggcctgccggggacggtgcacgtccgggccgtcgacgcgctcacccacgtacgggcatggctggccgaggaacgcttcgcgtccgcccggctggtgttcgtcacccgcggtgccatgaccgtgggttcggacgaggccgtccgcgatctcgcgggtgccgcggtgtggggtctggtccgctccgccggtaccgagcaccccggccggttcgctctcgtcgatctcgacgacgacgacgtgctgcccgagcagaccgtcctgacggccctggccgcaggggaatcggaactggtcgtacgcgagggatccctccttgtgccgcgcctcgcgcgtgctgctgtcgttgagggttccggtcgtgaactggacgtcgacggcacggtgttggtgacgggtgcgagtggcaccttgggtggtttgttcgcccgtcatttggtggttgagcgtggtgtgcggcgcctgctgttggtgagtcgtcgtggtggggctgcggagggtgctgctgaactgggcgccgaactcacggagctgggtgctgatgtgcggtgggcggcgtgtgatgtggccgaccgtgaggcgcttgagtcggtcctggccgggattcccgccgagtatccgttgtcgggtgtggtgcataccgctggtgtgctggacgacggtgtggtgtcgtccctgaccgctgagcgcgtgtcggcggtgctgcgtccgaaggtggacgcggcatggaacctgcatgagctgacccgtggcctggatctttctctcttcgtgttgttctcgtcggctgccggtgtgttcggtggtgccggtcaggcgaactatgcggcggcgaatgtgttcctggacgctctggcccagcaccgcagggcccagggtctggccgcgacctcccttgcgtggggtctgtgggctgagccgggtggtatggcgggcgcgctggacgctgatgatgtgtcgcgtctgggccgtggtggtgtcagcgggctgtccgcgggggagggtgtggcgttgttcgacgcggcatccgcgtccgaacaggccttgttcgttcccgtgaagctggacctggccgccctgcgcgcccaggcgggtagcgggatgctgccgccgctgctcagcggtcttgtccgtacccccacccgccgcgccgcgggcaccgccaacgctgcggtatccgccccgggggaccgcctcgccggattgtccgccgctgaacaggtggcgcacgtactggagttggtccgtactcaggttgccgcggtgctggggtacgcctccccggaggcggtcgagaaggacagctcgttccgcgagctgggcttcgactcgctgaccgccgtcgagctgcgcaacctgctcggcgcggcgacggggctgcgcctgcccgccacgctcgtcttcgactacccgacctcagcggtcctggccgaccacctgcggtcggagctggtcggaacggcgcccgtgacatcggctccggtcgttctcgcggcccgggacgatgacgagcccatcgcgatcgtgggcctcggctgccgctaccccggcggcgtggagagcccggacgacctctggcggctcgtcctggaaggccgggatgccatcacggagttcccggaggaccggggctgggacgtggacgcgctgttcgacgccgaccccgaccagcagggtacgagttatgcccgcgagggcggcttcgtccgcgacgcgggccacttcgacccggcgttcttcgggatctcgccgcgcgaggccgtggccatggacccgcagcagcgactcctcctcgaaacctcgtgggaggcgttcgaacgggcgggcatcgacccggcggccctgcgcggcagccggaccggcgtcttcgcgggtgtgatgtaccacgactacgcttcccggctcacggccctccccgagggcgtcgagggcttcctcggcacgggcaacgcggcgagcgtcatctccggacggctgtcgtacgccttcggcctggaaggcccggccatcaccgtcgacacggcctgctcgtcctcgctggtcgccctgcacctggcggtgcaggcgctccgcaacggcgagtgttccctcgctctcgcgggcggtgtcacggtcatggcgacccccgctgccttcgtggagttcagtcgccagcgcgggctcgcggccgacggccggtgcaaggcgttctcggccggcgccgacggcacgggctggtccgagggcgcgggcgtcctgctggtggagcggctctccgacgcgcggcgcaacggtcacccggtgctcgcggtggtccgtgggtcggcgatcaaccaggacggtgcgagcaacggtctgacggctccgaacggtccctcgcagcagcgggtgatccgccaggcgctggccagcgcgggcctgtcggcggcggatgtggacgtcgtggaggcgcacggcaccggcaccaccctcggcgacccgatcgaggcgcaggcgctcctcgccacctatggccaggagcacacggacgagcagccgctgctgctcggctcgatcaagtccaacttcggccacacgcaggccgccgccggtgtcgcgggcatcatcaagatcgtccaggcgatgcgtcacggtgtcgtccccaagacgctgcacgtggacgagcccaccccgcacgtcgactggtcggcgggcgcggtctcgctcctcaccgagcaggtggcctggcccgaaaccggccgtccccgccgcgcggcgatctcttccttcggcttcagcggcaccaacgcgcacgccatcatcgagcaggcccccgaccccgctcccgaggacctgcccgacgcaggacccgacgtacggcccgagcccgcccggactccgggcagcctgccgtggctcctctcggcgaagggcgcggacgccctgcgcgaccaggccgcccggctccgggcgcatgccatcgggcaccccgagctgtccctcgccgacatcggctacgccctggccacgagcaggaccgcgctcgaccggcgggccgccgtggtcgccggggaccgcgaggagttcctcgcgggactcgcggcgctcgccgagggtgccacggcggccggcctgacggagggatcaccggccggtggcaagctcgccttcctgttcaccgggcagggcagccagcgcctggccatgggcagggagctgtactccgcccatcccgtcttcgcccgggccctggacgccgtgtgcgacgggctcgccctggacgtaccgctgaagcaggtgctgttcgggtccgacgcggacctgctcgaccggaccgcgtacacccagcccgccctcttcgccgtcgaagtcgcgctgttccgcctggtcgagagctggggcctgaagcccgacttcctggccgggcactccatcggcgagatcaccgcggcccatgtggccggggtgctctccctcgacgacgcctgcacgctggtcgccgcccgcggccggctcatgcaggcactgcccaccggcggcgtgatgatcgccgttgaggcatcggaggacgaggtcctgccgctgctcaccgaccgggtgagcatcgccgcgatcaacggcccccagtcggtcgtgatcgcgggtgacgaggccgacgcggtggcgatcgcggagtccttcaccggtcgcaagtccaagcggctcacggtcagccacgccttccactcgccgcacatggacggcatgctcgacgccttccgcgaggtcgccgagggactgtcgtacgggaccccgctcatcccggtcgtctcccacctcaccgggaccctggtcaccgacgagatgcggtcgccggacttctgggtccggcacgtccgcgaggcggtccgcttcctggacggcatccgcacgctggaggacgcgggcgtcaccacgtacatcgaactcggccccggcggcgtcctctccgcgatgggtcagtcgtgcgtcacgcgcgacgacgcggccttcctcccggccctgcgcgcggaccgctccgaagaggagacgctcacctcggccgtcgcccgggcacacctgcgcgggatcaccgtcgactgggacgcgtactactccggcaccggcgcccggcgcgtcgacctgccgacgtacgccttccagaggcagcgctactggctggaggcccccgcccacgcccccggcggggacgtgacgtccgccgggctcggctccgcggggcacccgctcctcggcgcggccgtcgaactgccggactcggacgggttcctgttcaccgggcggctctccctgcgcacccacccctggctcggcgaccacagggtggcgggcaccgtcctgctgccgggcgccgcgctgctggaactcgccgtgcgcgccggggaccacgcgggctgcgatctgctggaggacctcacgctggaggctccgctcgtactgcccgaggcgggcggggtacagctgcggctcgtcgtggccgaacccgacgcgtcgcgcaggcgggtgttccacatctactcccgcccggaggacgcggccttcgaggagccgtggacccggcacgccggcggtgtcctggccgtcgagggcgcgcacccggccgaggcggagtccgagtggccgcccgccggagccgtcccctgcccggtggaggacctctacccgtcgctcgacgccatcgggctcggatacggtcccgcgttccgcaatctgctgctggcctggaagcgcggcgacgaggtgttcgccgaggtcgctctcggcgaggaccggcggaccgaaggcgccctctacgggctccacccggcgctgctcgacgccgccctgcacgcggtcggcctcggggacttcttccccgacgggcccgagggcgcgcggctgccgttctcgtgggacggcgtgcggctgcacgccgtgggcgccgcggcgctccgggtacggatggcaccggccgggcaggacgcggtcacgctggccgtctccgacgaaacgggccggccggtcctcaccgtcgactcgctcgtcctgcgtccgctggccctcgatggtccgggcgggctcggcggagcgggccggggaccgggttcggtgcgcgacgcgctgttccaggtcgactggcacgcgctgccgctgcccgaggcgcagtcaccggccgaaggccgctgggccctgctcggcggcgacccgctgaagctggccgccgcgctggagcgcaccggggtcctggagccgggcgcgctgttcggcacggcctccgaggacaccggcgggcaccctcgcgacctgtccgccctggcggacgcggtcgagctggccgaggcactcggggagcccgcgcccgagaccgtcctcgtctccctggcacccgacctcgccgccacgggcggcctcgcgtcggccgcccaccgcgccgccgcggacgcgctggagctgatccaggcctggctggcggacgagcggctcgccggttcacggctggccctcgtcacgcggggcgccgtcgccacggaccccgacgcggacgtggacgacctcgcgcacgccgcggtgtggggactggtgcgctccgcgcaggccgagcaccccggccggctggttctggtcgacctcgacgacgaggacgactcctaccgggccctgcccgccgcgctcgacaccgatgagacccagctcgccgtgcgcgacggggccgtcctggccccgcgtctggcgcgagcggtcatcgccccggcaacggatgcggcggccccggacgttgccccggacccggagggcaccgtcctcatcacgggcgccagcggcaccctcggcggcctgctggcccggcacctggtgacggagcacggtgtgcggcatctgctgctcaccagccgcaggggcgccgctgccgaaggcgccacccaactcgcagacgaactcgtcacgttgggtgcgcaggtcacctgggcggcgtgtgacgcggccgaccgggacgcgctggccgcgctgctggagtccgtacccgcggcccatccgctgacggccgtcgtgcacaccgccggtgtgctggacgacggcacggtcgagtcgctgaccgccggacggatggcgacggtgctgcggcccaaggtcgacgccgcgtggaacctgcacgaactgacccacggactcgacctggccgcattcgtcctgttctcctcggcggccggtgtgttcggcaacgccgggcaggccaactacgcggcgggcaacaccttcctggacgccctcgcccagcaccgccgcgcccagggcctcacggccgtctcactggcctggggtctgtgggacgacgaggcgggcatggcagccaccctcgacgagcaggaccggcggcgcctgagccggggcagcatgaacccgctgtcggtggccgaggggctcgcgctcttcgacgccgcgctgccgggcggggcatcctccggcgccgtgcccgagggcgcgcggaccgcgagcgtactcgtgcccgcgcggctcgacttggccgtgctccaggcccaagtgggggatctcgtaccgcccttgctgcgcggcctgctccgtactccggtacggcgcagggcgagcggcgcggcggccgacgcgcccgactcgctggcgcagcggctcgcccaactgccgcccgccgaacgggaccgggtgctgctcgacctcgtctgcacccaggtggcccaggtgctgggccacagcggcgcggccgccatcgaaccgggaagcgccttcaaggaactcggcttcgactcgctgaccgcggtggagctgcgcaaccggctcggtgccgtgacggggctgcgcctccccgccacgctcatcttcgactacccgacccccgaagcgctgagcggacatctgcgctccgcgctgcccctcgacgaggacggaccgtccgtcttcagcgaactcgaccggctggagagcgccttgggcgcggcggacgcggacagcgtcacgcgttcacggatcacgatgcgcctccaggccctgatgaccaagtggaacgacgcacaggacgcgaacggcggcgcccccgacgaggacgccgacgacggcgccctcgaaacggcgaccgacgacgagctgttcgacctgctcgacaacgagctcggcgcctcctgagaaaccgcgcggcgcgcctcccttccgggccttccgggcggggggcgcgccgccccgcaccaccgcaacagccacgggatcccgcacgccgggaccccgggccacccagacgaccgaccgtacaaccgcctctctggcatggagcccacgcaatggtgaacgaggacaagcttcgcgactacctcaagcgggcgaccgccgatctgcgccaggcccgcaggcggctgcgcgaggtcgaggacaagaaccaggaacccatcgccatcgtcgcgatgagctgccgctaccccggcggcgtccgcagccccgaggacctgtggcggctcgtggagaacggcgacgacgccgtctccggcttccccgtcgaccgcggctgggacgtggaggcgctctacgacgccgaccccgacagctccggatccagctacgtcagcgagggcggcttcctctacgacgccgcgagcttcgaccccgcccccttcgggatctcgccgcgcgaggccctcgccatggacccgcagcagcggctgctcctcgaagcgtcctgggaggcgttcgagcgcgcgggcatcgacccgtcgtccgtgcgcggcagccggacggccgtgttcgccggtgtgatgtaccacgactacaccgcgcgcctcgattccgtgcccgagggcgtcgaaggattcctcggcaccggcagctcaggcagcatcgcctcgggccgggtggcctacacgttcggcctggagggcccggcggtcaccgtcgacacggcctgctcgtcctcgctcgtcaccctgcacctggccgtccaggcgctgcgggccggcgaatgctcgatggcgctcgcgggcggtgtcaccgtcatggcgacccccgcgaccttcaccgagttcagccgccagcgcggcctcgcgccggacgggcgctgcaagcccttcgcggccgccgcggacggtacgggctggggcgaaggcgtcggcatgctcctcgtcgagcgcctttcggacgctcagcgcaacggacatccgatcctcgcggtggtccgcgggtcggcgatcaaccaggacggtgcgagcaacggcctgacggctccgaacggtccgtcgcagcagcgcgtcatccaccaggcgctcaccaacgcacggctgtcggccgcggatgtggacgtcgtcgaggcgcacggtacggggacgaccctcggcgacccgatcgaggcgcaggccctgctcgccacctacggccaggaccgcccggccggacgcccgctgctgctcggctccatcaagtccaacatcggccacacccaggccgccgcgggtgtcgcgagcatcatcaagatggtcgaggcgatgcgtcacggagtggtccccaagaccctccacctcgacgagccgactccgcacgtggactgggaggcgggcgccgtctccctgatcggcgagaagatcgcctggccggagaccggtgaactccgtcgtgcgggtgtgtcgtcgttcgggttcagcgggacgaacgcgcatgtgatcgtcgagcaggctccggtggtcgaggaggtggcgggggatccggccggtgaggtcgagggttcggaactcgcggtggtgccgtgggtgttgtcgggcaagagtgcgggggcgttgcgggcgcaggcggagcggttgtcggggtggctcgccggtgcttcggctgcgggtgtggcgtcggttgacgtgggctggtcgttggcgtcgtcgcgggccgggctggaacaccgggctgtggtgctgggcgatcacgcggccggtgtgggggcggtggcgtcgggtgtgatggccgcgggtgtggtgacggggtcggttgtcggcgggaagaccgcgttcgtgttcccggggcagggctcgcagtgggtgggtatggcggtggggttgctggattcctcgccggtgttcgctgcgcgggtggatgagtgtgcgaaggcgttggagccgttcactgactggtcgttggtggatgtgctgcggggtgtggagggtgcgccgtcgttggagcgggtggatgtggtccagcctgctctgttcgcggtgatggtgtcgttggcggaggtgtggcgggctgctggtgtgcgtcctggtgcggtgatcggtcattcgcagggtgagatcgctgcggcgtgtgtggcggggatcttgtcgcttgaggacgccgcgcgagtggttgcgttgcgcagtcaggcgatcggccgggtcctggcaggtctcggcgggatggtgtcggtgccgctgcccgcgaaggcagtacgagagctgatcgctccgtggggtgagggccggatctcggtggccgcggtgaacgggccgtcctcggtggtcgtttcgggtgaggccgccgccctggacgagatgctggcctcgtgcgagtcggagggtgtgcgggcgaagcggatcgcggtggattacgcgtcgcattcggctcaggtggagttgctgcgggaagagcttgctgagctgctggctccgattgttccgcgcgctgctgaggtgccgttcttgtcgacggtgacgggtgagtgggtgcgaggcccggagctggatgctggttactggttccagaatctgcgccggacggtggagttggaagaggcgacgcggacgttgctggagcagggcttcggtgtgttcgtcgagtcgagcccgcacccggtgttgagcgtgggcatgcaggagacggtcgaggacgcgggccgggaggcggctgttctgggttcgctgcgtcgtggtgaggggggtctggagcgtttctggctgtcgctgggtgaggcctgggtccgtggcgtggctgtcgactggcatgccgtgttcgcgggtacgggtgcccggcgggtggacctgcccacctacgccttccagcaggagcactactggctcgaaagcggcaccgccgaggacgtcacggccaccgcccaccccgtcgacgccgtcgaagcccgcttctgggaggccgtcgagcgccaggacgtggcggcgctcaccgccgagctggacgtggacgagaacgagaacctcaccgcgctgctgcccgcgctgtcgtcgtggcgtcggcagagccgtgagcggtccgccgtggacggctggcgctaccgggtgacctggaagcccgcgccggagcccacgacggcccgcctctccggcacctggcttgttgccgtcgccgagggcgcgccgggtgatgagtggacgtccgctgtcctgcgtacgctcgccgaacacggcgccgacgtacggcagatcacggtcgcccggaccgaggacacccgggccggtctcgccgagcggatacgtgacgtactcgcggacggtcccgcggtgtcgggagtcttgtccctgctgaccccggcgggggccgacgagccgttccaggtctccgcgcccggcggtgtgatcaccaccctgtccctcgtccaggcgctcggcgacgccgaggtggccgcacccctgtggtgcgtcacgcgcggcgccgtcgccaccggccgttccgagcaggtggccgaccccgcgcaggctccggtctggggcctgggccgggtgaccgcgctggagcacggcgagcgctggggagggctgatcgacctgcccggcacggacgccgtggacgaccgggcactcgcccggctcgcgggcgtcctcgccggtgacgccgccgaggaccaggtggcggtgcgcgcctccggcctcttcgtacgacggctcgtacgcgtccgtctcgccgagacgcccgtcgtacgggagtggcgtccgcagggcaccaccctggtcacgggcggtacgggcgcgctgggcgcgcacgtggcccgctggctcgctgagaacggcgccgagcacctgctgctcaccagccgccggggccccgacgcgcccggagccgccgcactccgcgacgaactcaccgccctcggcgcccaggtcaccatcgcggcctgcgatgtgagcgaccgggacgccgtcgcggccctcatcgccgcggttcccgccgaccagcccctcaccgccgtcgtgcacacggcggccgtcctcgatgacggggtcatcgaggcgctcacgcccgagcagatcgagcgcgtcctgcgggtgaaggtcgacgcgacgctgcacctgcacgaactgacccgcgagctcgacctgtcggcgttcgtgttcttctcgtccttcgccgccaccttcggcgcccccggccagggcaactacgcgccgggcaacgcgttcctggacgccttcgccgagtaccgccgggcatccggactgcccgccacctccatcgcctggggcccttggggcgacgggggcatggccgagggcgcggtcggtgaccggatgcgccgccacggggtcatcgagatgtcgcccgagcgtgccgtcgccgcactccagcacgccctggaccgcgacgagacgaccctgaccgtcgccgacatggagtggaagcgcttcgtcctcgccttcacctccggccgcgccaggccgctgctgcacgacctgcccgaggcgcgggaggtcatggacgccacgcgcacggaggcggcggaggacaccggcagcgccgccgcgctggcccagcagctgaccggccggcccgaggccgaacaggagcgactgctcctcgaactggtccgcaccgccgtcgccgccgtcctcggctacgcgggccccgacgcggtcgaggcgggccgggccttcaaggagctgggcttcgactccctcacctccgtcgaactgcgcaaccgcctgaacgcggccagcggcctcaagctgccgcccaccctcgtcttcgaccacccgacgcccaccgtcctcgcccggcacctgcgggccgagttcttcggccagggcgccgcggccgccgtgcccgtgccgatggccgcggtctccgacgacgagccgatcgccatcgtcgcgatgagctgccgcttccccggcggggtccgcaaccccgaggagctgtggcagctgctcacctccgagggtgacgggctgtcccagttccccctggaccgcggctgggacgtcgacgcgctgtacgaccccaaccccgacgcgcaaggcacctcgtacacgcgggagggcggcttcctgtccgacgccgcggccttcgactcctcgttcttcgggatctcgccgcgcgaggccctcgccatggacccgcagcagcggctgctcctcgaaacctcgtgggaggcgttcgagcgggcgggcatcgacccgcagaccctgcgcggcagccagtccggtgtgttcgtcggcaccaacggctctgactactccaacctcgtacgggcgggggcggacggcctggaggggcacctggccaccggcaacgcgggcagtgtcgtctccggccggctctcctacaccttcggtctcgaaggcccggccgtcaccgtcgacaccgcctgctcggcctccctcgtcgccctccacctcgccgtgcaggccctgcgcagcggtgaatgctcgctcgccctggccggtggcgtgacggtgatgtccacgccgggcaccttcatcgagttcagccgtcagcgcggactctccaccgacggccgctgcaaggcgttctcctcggacgccgacggattcagccccgcggagggcgtcggcgtgctcctcgtcgagcgcctttcggacgctcggcgcaacgggcatccgatcctcgcggtggtccgtgggtcggcgatcaaccaggacggtgcgagcaacggtctgacggctccgaacggtccgtcgcagcagcgcgtcatccggcaggccctcgccaacgcacggctgtcggccgcggatgtggacgtcgtcgaggcgcacggtacgggtacgacgctgggtgacccgatcgaggcgcaggccctgctcgccacctacggccaggaccgcccggccggccggccgctgctgctcggctccatcaagtccaacatcggccacgcccaggcggcggccggtgtcgcgggcgtcatgaagatggtgctcgccatgcagcacggagtgctgccgcagagcctgcacatcgccgagcccacgccgcacgtcgactggagcgcgggcgaggtcgccctgctcaccgaggagcgggcctggcccgagaccggccgcccctggcgggcgggcgtctcgtcgttcggcttcagcggcaccaacgcccacgccatcatcgagcaggctccggccgaagcgggatccgacgacgaccgggagacccctgagccgtcggcccaacccctactggtcgcgcccacccgggacgactccgcgtccgcccgggacgactccgcgtccgccccggacggctccgtatccggcccggacgactccgtgtccgaccgtcccggcgtgctgccctggaccctgacggccaagaccgagaaggcgctgcaaggccaggccgaacgcctgctgacccagctcaccacccgctctgacctgcgacttgtcgatgtcggccactccctggcgacgacccgtaccgcgctcgaccagcgcgccgtcctcatcggacgggaccgccccgactacctcggagccctgaccgcactcgcggcgggggacacctcccccctgctggtgcagggggcggtcgtcggggggaagacggcgttcgtgttccccggacaggggtcgcaatgggtaggcatggcggtggcgctgttggacgcttcacccgtgttcgctgcccgagtggatgagtgtgcgaaggcccttgagcccttcaccgactggtcgctgcgcgatgtactgcgcggcgtcacaggcgcgccgtcgttggaccgcgtggatgtggtccagcctgctctgtttgcggtgatggtgtcgttggcggaggtgtggcgggccgctggtgtgcgtcctgatgcggtgatcggtcactcgcagggcgagatcgctgccgcgtgtgtggcgggcatcttgtcgcttgaggacgcggcgcgagtggtcgcgttgcgcagtcaggcgatcggccgggtcctggcgggcctgggcgggatggtgtccgtggcactgccggcgaaggctgtgcgggagctgatcgctccgtggggcgaggaccggatctcggtggccgcggtgaacgggccttcctccgtggtcgtttccggtgagaccgccgccctggacgagctgctggcctcgtgcgagtcggacggcgtccgggcgaagcggatcgcggtggattacgcgtcgcattcggctcaggtggagttgctgcgtgaggagcttgctgagctgctggctccgattgttccgcgggctgccgaggtgccgttcctgtcgacggtgacgggtgagtgggtgcgcggtccggagctggatggcgggtactggttccagaacctgcgtcggacggtggagttggaagaggcgacgcggacgttgctggagcagggcttcggtgtgttcgtcgagtcgagcccgcaccccgttctgacgatgggtgtgcaggagaccgtcgaggacgcgggccgtgacgcggctgttctgggctcgctgcgtcgtggtgaggggggtctggagcgtttctggctgtcgctgggtgaggcctgggtccgtggcgtgggtgtggactggagtgccgtgttcgcgggcacgggtgcccggcgggtggatctgcccacttacgccttccagtcgcagcggttctggccggaggccgcgcccatcgaggctgtggcggtgtcggcggagagtgcgatcgatgcgcggttctgggaggccgtcgagcgcgaggatctcgaagcgctgaccgctgagctcgacatcgagggcgaccagccgctgaccgcgctgctgcccgcgctgtcgtcgtggcgtcggcagagccgtgagcactcgacggtggacggctggcgctaccgggtcacctggaagccgctggccgaggccaagacctctcgcctctccggtacttggctggtcgtcgttcccgagaacggcccggccgacgagtggacgggggccgtgctgcgcgtgctcgccgaccgcggcgcggaggtccgtactgtgaccgtcccggccgacggggccgatcgtgaccggctcgccgccacgctgaaggccgagacggacggggccgctccggccggagtgctgtccctcctcgcccttgccgtcgaaagcgctgaactccgtacgcacaccgggctcctcgccaccgccgcgctcgtccaggcgcttggtgacgccgatgtggccgcacccctgtggtgcgtcacgcgtggcgctgtctccgtcgcccgtacggagcggctccaggacccggcgcaggcgctcgtgtcgggcttcggacgcacggtcgccctggagtacccggaccgttggggcggtctcgtcgacctgccggagcaggccgacggccgtacgctcgaacgtcttgcgggtgtgctggccggtgacggttccgaggaccaggtggcgctgcgcgcctcgggtctcttcggccggcgtctggtccacgcacccctcgccgacaccgccgcggtacgggagtggcgtccgcagggcacgaccctggtcaccggtggtacgggtgcgctgggcgcgcacgtggcccgctggctcgctgagaacggtgccgagcacttgctgctcaccagccgccggggcccggacgcgcccggtgccgccgaactccgcgacgaactcacggccctcggcgcccaggtcaccatcgccacctgcgacatggccgaccgggacgccgtcgcggccctcatcgccgccgttcccgccgaccagcccctcaccgcggtgatgcacacggccggtgtcctcgacgacggcgtgatcgacgcgttgactccggagcggttcgggacggtgctcgcccccaaggcggacgcggccctcaccctccatgagctgacccgcgagctgggcctctcggcgttcgtcctcttctccggtgtcgcgggcacgctcggcgacgcgggacagggcaactacgccgccgcaaactcctacttggacgccctcgccgagcagcgtcacgccgacggcctcgccgccacctcggtggcctggggtcgctggggcgacagcgggctcgccgcgggcggtgcgatcggtgagcggctcgaccgcggcggggtgcccgccatggcaccccgctcggcgatccgcgcgctgcagctggccctcgaccacgcggaggcggccgtcgccgtcgccgacatccagtgggagcggttcgcgcccggctacacggcggtgcggcccagcccgttcctcggtgacctgccggaggtgcggcagctcgccgcgtccgctccggcggccggtgaagcgggcggggactccccggccgaggcgctgcgccgacggctcgccgtcatgccgcaggccgaacaggccctggccgtcctcgaactggtccgctcccacgcggccaccgcgctgggccaccccacgaccgacgaggtgggcgcgggccgcgcgttcaaggagctcggattcgactccctgatcgcgctggaactgcgcaaccggctcaacgcagccaccgggctgaggctcccggccacgctcgtattcgaccacccgaccccgacgatcctggccgagttcctccgggccgagatcacccaggacggcagtgccggggccgccccgggcatcacggaactcgaaaagctggagtccgcgctgtccgttctcgacccggacagtgaaacgcgtaccgatatcgcactgcgcctgcaggcacttctcgcgaaatggggtgaaccgcacatcgaatcaagtggcgaggccgtgaccgagaaactccaggaggccacgcccgacgaactcttcgaattcatcgagaaagagttcggtatttagcacagcggacagcaggcagtagcagcgcaagggtttgtgacgagaagcatgggtgaggttccaatggcagatcaggacaagatcctcggttacctgaagcgggtgacggccgatctgcaccagacgcgccagcgccttcgtgaggtcgaggcccaggagccggagccgatcgcgatcgtcggcatgagctgcaggttccccggcggcatcgagtcgccggagggcctgtgggacctggtggccggtgggcgggacgcgatcaccgatttccccaccgaccgtggctgggacatcgagtcgctgtacgacgccgaccccgaccagcagggcacctcgtacacccgtgagggcggattcctcgacggcgtcgggaagttcgacgcgtccttcttcgggatcagcccgcgcgaaaccctcggcatggacccgcagcagcgcctgctcctcgaaacgtcctgggaagccttcgaaagagccggaatcgacgcggctaccctgcgcggcagcaaggccggtgtcttcataggcaccaacggccaggactatccggagctgctgcgcgaagtccccaagggtgtcgagggatatctcctcaccggaaacgcggccagcgtcgtctccggccgcatttcctacaccttcggcctcgaaggcccggccgtcaccgtcgacaccgcctgctcggcctcgctcgtcgccctgcacctcgccgtccaggcgctgcgcaacgacgagtgctcgctggcgctggcgggcggtgtcaccgtgatgtcgagcccgcgcgcgttcgtacagttcagccgccagcgcgggctcgcgcccgacggacgctgcaagccgttcgccgacggggccgacggcaccggctggggcgagggcgtcggcatgctgctcgtcgagcggctctccgacgcccgcaggaacggtcatcccgtcctcgccctcgtgcgcggctcggcgatcaaccaggacggcgcgagcaacggcctgaccgcgcccaacggcccgtcccagcagcgggtgatccggcaggcgctcacgaacgccgggctcacccccgcgcaggtcgacgtcgtcgaggcgcacggcaccggtacgaccctcggcgacccgatcgaggcgcaggccctgctcgccacgtacggccagaaccgccccgaggggcgcccgctgtggctgggttccgtcaagtcgaacatcgggcacacgcaggccgccgccggtgtcgcgggcatcatcaagatggtcctcgccatgcagcacggcgtgctgcccgagtcgctccacatcgaccagccgtccggcaacgtcgactgggccgccggtgacgtcaagctgctcaccgaggccgtgccgtggccgcagaccggccagccgcgccgcgccggcgtctcctccttcggcgtcagcggcaccaacgcgcacaccgtcatcgagcaggccccgcccgccgacgacgcgccggagaccggcgcggacaccgcacccaccgccgaggcgccggaggcggcctccgcggacgcttccgaggccgggacgccgaccggtgccaccggcccggtgccggtgctcgtctcgggccagagcgacgccgcactgcgcgcccaggccgagcgcctcgccgcccacctgcgcgcccaccccggactcggggccgacaccggaaccctgaccgacctcggtttctcgctcgccaccagccgctcctcgctcgaccgcagggccgtcctgttcggcgaccgggacagcctgctcgccgacctcagcgccctcgccgagggcgagcagcccgccggcccggtcctcggcgcggtgggcgagggcaagaccgccttcctcttcaccggccagggcagccagcgcctgggcatgggacgcgagctgtacgccacgcatcccggcttcgcccgcgccctcgacgaggtccgcgcggaactggaccagcacctcgaacgccccctgttcgacgtcctgttcgccgccgaaggcacccccgaggcggacctgctcgacgagaccgcctacacccagagcgccctgttcgccgtcgaggtcgccctgttccggcagctcgaacagtggggcgtcggcgccgacttcctcatcggccactccatcggcgaactcgccgccgcccacgtctccggcgtgttcaccctcgccgacgcggccaagctcgtcgccgcccgcggccgcctcatgcaggcgctgcccgccgacggcgcgatgatcgccgtcgaggccaccgaggacgaggtcgcaccgctgctcaccggccgggtgagcatcgccgccgtcaacggcccccgctccgtggtcgtctcgggcgacgaggacgccgccacggcgctcgccgagaccctgcgcgcacggggccgcaggacgaagcggctcacggtcagccacgccttccactcgccgctgatggacggcatgctcgacgcgttccgtgaggtcgccgagagcgtcgcctacgcgccgcccgtcatcccgatcgtctccaacctgaccggcgcctccgtcaccgcggaggagatctgcgccgccgactactgggtgcgccacgtccgcgaggccgtccgcttcctcgacggagtccgcaagctctccgcgcagggcgtcaccaccttcgtcgaggtgggaccgggcggggtcctcaccgccctggcgcaggagtgcgtcaccggccaggacgccgtcttcgtgcccgtcctgcgcggtgaccgccccgaggcggccgccttcgcgacggccgtcgcccaggcccatgtccacggtgtggccgtcgactggtccgccgtcttcgccgggcgcggagccacccgcatcgacctgccgacgtacgccttccagcgcgagctgtactggcccgagcagcccaccgcctgggcgggcgacgtcaccgccgccgggatcggcgccgccgaccacccgctgctgggcgcggccatcgccctggccgacggcgacgggcacctgttcaccgggcggctctcgctggccacccacccctggctcgccgaccacacggtgatggacaccgtgctgctgcccggcaccgccttcgtcgaactcgccctccaggcgggcgaccacaccggctgcgacctgctggacgaactcaccctggaagcaccgctggtgctgcccccgcacggcggggtgcagatccagctcgccgtgggcgcgcccgacgccgagggccgccgctcgctgacactgcactcccggcccgaggacgccgccgacgacacctggggagagggcgcctggacgcgccacgccaccggcttcctcgccaccgccgcccagggcgcccgcgagcccctcgccgacctcaccagctggccgccgaagaacgccacgaaggtcgacgtagaaggcctgtacgcgtacctcaccgagtccggcttcgcctacggtccggtcttccagggcctgaccggcgcctggcagcgcggcgacgaggtcttcgccgaggtccgcctgccggagcaggcgcacgccgaggccgccctgttcggtctgcatcccgcgctgctggacgccgcgctgcacgccgtcggcatcggctccctcctggaggacaccgaacacggcaggctgccgttctcctggagcggagtctccctgcgggcggtcggcgcccgtgccctgcgcgtccggctcgcccccgcaggcaacgacaccgtgtcggtgaccctcgccgacgagaccggagcgcccgtcgccgccgtcgacgcgctgctgctgcggcccgtctccccggaccaggtgcacgccgcccgcaccgccttccacgactcgctgttccgcgtggagtggaccggtacgcccctcccggccgccaccaccgtcgccgcgggccagtgggcgctgctgggcgagccccgtacggagttcaccgccgcgctgcccaccgccgccacccacgccgacctcgccgccctcggcgcggcgctggacgcgggcggcccggtcccgcgggccgtcatcgtcccgttctccgcgtccggcgccccctcggcgactcccgtcgacgccgcgctgcccaccgccgtcgccgacgccctgcaccgcaccctggagctcgcccaggcgtggctcgccgacgaccggttcgccggctcccggctcgtgttcgtcacccgcgacgccgtcgccaccaccgccggatccgatgtcgccgacctggcccacgccccgctgtggggtctgctgcgctccgcgcagtccgagcaccccgaccggttcgtcctgctggacctggacggacgcgaggactccctgcgggccctgcccgccgcgctcgccacggccgagccgcagctcgccctgcgcgcgggcaaggccctcgtgccccggctcgcccgggtcgccgccgcccccggccaggaggcgcccgcgctcgaccccgacggcaccgccctggtcaccggcgccaccggcaccctcggcggcctggtcgcccgccacctcgtcgccgcgcacggcgtccgccacctgctgctgaccagccggcgcggcgaggccgccgccggcgccgccgaactcgccgccggactgcgggaactgggcgccgaggtcaccatcgcggcctgtgacgccgccgaccgcgacgcgctcgccgcgctcatcgggtccgtaccggccgaacacccgctcaccgccgtcgtccacaccgccggagtcctcgacgacggcgtcctcgaagcgctcacccccgagcgcatcgacgccgtcctgcccgccaaggtcgacgcggccgtgcacctgcacgagctgacccgcgagctggacctcgcggccttcgtcctgttctccgccgccgccggcaccctcggcggccccggacaggccaactacgccgccgccaacaccttcctcgacgcgctcgcccaccggcgccgcgccgaaggactgcccgccaccgccctcgcctggggcctgtgggccgaacgcagcggcatgaccggcgacctcgccgacgccgacctggagcggatctcccgcgccggagtcgccgccctgtcgtccgccgagggcctggcgctgctggacaccgcccgcgccgtgggcgaccccaccgccgtccccatgcacctcgacctggcgtccctgcgccacgccgacgcgagcatggtccccgcgctgctgcgcggcctggtccgcgcgcccgcccgcaggtccgtcgagtccccgggcgccgccccggccggcggcctcgccgagcgcctgctgcccctgaccgccgccgagcgcgaccggctgctcctggacaccgtccgggtccaggtcgccgccgtcctcggctaccccggccccgaggccgtcgacccgggccgtgccttcaaggaactcggcttcgactcgctgaccgccgtagagctgcgcaaccgcctcggctccgccaccggcgtacggctgcccgccaccctcgtcttcgactaccccaccccgaacgcgctctccgcgttcctgcggaccgaactcctcggcgacgccgcggactcggccccggtcgcggccgtcaccgcccgtgacgacgagcccatcgccatcgtcggcatgagctgccgctaccccggcggggtcaccacccccgaggagctgtggcagctcgtcgccggctccgtcgacgcgatctcgcccttccccacggaccgcggctggaacctcgacgcgctgtacgacgccgaccccggccgggccgggacctcgtacacccgggagggcggcttcctgcacgacgccgccgacttcgacccggacgtcttcggcatcaacccgcgcgaagccctcgccatggacccgcaccagcggctcctcctggagacgtcctgggaggcgttcgagcaggccgggatcgccccctcgtccatgcgcggcagccgcaccggcgtgttcgccggcgtcatgtaccacgactacctgacccggctcccggccgtgcccgagggcctggagggctacctcggcaccggcaccgcgggcagcgtcgcctccggccgcatctcgtacaccttcggcctcgaaggccccgccgtcaccgtcgacacggcctgctcctcctcgctggtcgccctgcacctcgcggcccaggccctgcgcaacggcgaatgcgacatggccctcgcgggcggtgtcaccgtcatgtccaccccggacaccttcatcgacttcagccgccagcgcggcctctccggcaacggccgctgcaagtccttctccgccgacgccgacggaaccggctgggccgagggcgcgggcatgatcctcgtcgagcggctctccgacgcccgccgcaacggccaccaggtcctggcggtcgtccgcggcaccgccgtcaaccaggacggcgccagcaacggcctgaccgccccgaacggcccctcccagcagcgcgtcatccgccaggccctcgccaacgcgggcctgaccaccgccgaggtcgacgtcgtcgaggcgcacggcaccggcaccaccctcggcgaccccatcgaggcgcaggccctcctcgccacctacggccaggaccgcccggccgggcagccgctgcggctcggctccatcaagtccaacatcggccacacccaggccgcggcgggcgcggcgggcatcatcaagatgatcctcgccatgcgccacggcgtcatgccgccgtcgctgcacatcggcgagccgtccccgcacatcgactggaccgcgggcgcggtctcgctgctcaccgaggccgccgagtggcccgacgcgggccgcccccgccgcgcgggcatctcctccttcggcgtcagcggcaccaacgcccacgtcatcatcgagcagccgcccgtcgaggaacccgccaccgcgaccgagaccggctccggcaccggcctgcccgccggcacgcccctgccgttcgccctctccggccggacccccgccgcgctgcgcgcccaggccgcccggctgatcggccacctcgcgccgcggcccgaggccgcccccgccgatgtggcgctctcgctggccaccacccgtaccgccctggaccgcagggccgccgtcatcgcgcacgaccgcaccgagctcctcgccgggctcaccgccctggccgagggccacgacagcgcccggctggtccagcacaccgccgccgacggccgcaccgcgatcctgttcaccggacagggcagccagcgccccggcatgggacgcgagctgtacgagacgtaccccgccttcgccgaggcgctggacgcggtctgcgccgagctggacccgcacctcgaacagcccctcaaggaggtcctgttcaccgccgacggcgacctgctgaaccggaccggccgcacccagcccgccctgttcgcgctggagaccgccctgtaccggctcgtcgaatcgtggggcgtgcgccccgacttcgtcgccgggcactccatcggcgagatcaccgccgcgcacgtcgcgggcgtcctctccctgcccgacgcggccaccctggtcgccgcccgcggccgcctcatgcaggaactgcccgagggcggcgcgatgatcgcgctcaccgccaccgaggacgaggtcctgccgctgctggccggccacgaggaccgcatcggcatcgccgccgtcaactcagcctcctccgtggtcatttccggcgaggagggcctcgcgctggagatcgccgccgagttcgagcggcgcggtcggcgcaccaagcggctcaccgtcagccacgccttccactcgccgctgatggacggcatgctcgacgccttccgcgaggtcgccgagtccctgacctaccgggcgcccgccatcccggtcgtcacgctcctcacgggaacggtcgccggggacgaactgcgcaccgccgagcactgggtctcccacgtccgcgaggcggtccgcttcctcgacggcatccgcaccctggacgccgagcacgtcaccacctacctcgaactcggcccgcagggcgtgctgtccggcctcggccgcgactgcctcaccgaccccgccgacccggccgacaccgccgtcttcgtaccggcgctgcgccgcgaccgcggcgaggccgaagccctgaccgccgcgatcgccgcggcccacacccgcggtgtgccgctcgactggtccgcgtacttcgcgggcaccggcgcccgccgcgtcgaactgcccacctacgccttccagcgcgagcggttctggctcgaagccccggccggctacatcggcgacgtcgaatcggcgggcatgggcgcggcccaccacccgctgctcggcgccgccgtcgccctcgccgacggcgaaggattcctgttcaccggccggctctcgctcgacacccacccctggctcgccgaccacgccgtcatgggcaacgtcctgctgccgggcaccgccttcgtcgaactcgccatccgcgcgggcgaccaggccggctgcgacctcctcgaagaactcaccctcgaagcaccgctgatcctcgccccgcaggccgcggcacgcctccagatcgtggtcggagcccccgacgggtccggccgccgcaccctggacgtgtactccagcgacccggacgcccccgccgacgagccgtggacccgccacgccggcggcatcctcgccaccggggcacaggcacccgccttcgacctgaccgcgtggcccccgccgggcgccgaagccgtcggcgtcgacggcctctacgaacacctcggccggggcggcttcgcctacggtcccgtcttccaggggctgcgcgccgcctggctcctcggcgacgacgtgtacgccgaggtcgccctgcccgacgaccggcaggccgaggccgcccggttcggcctgcacccggcgctcctcgacgcggccctgcacgccaccttcgtccagccgtcccccgacggggaccagcagggccggctgccgttctcctggcgcgatgtgtccctgcacgccgtcggtgcgtccgcgctgcgcgtccgcctcacccccgacggccgggacaccctctccctccagctcgctgacaccaccggcgctcccgtcgccgccgtcggccacctgacgctgcggcccgtctccgccgaccagctcggcagcgcacgctccgcacaccacgagtccctgttccggatcgactgggccaccgtgccgctgccgtccgacgcccccgccgccacggacgagtgggccgtcatagccgcggacggaggcacggacggcggtacggacggaggcacggacggcggcatccccgccgccctccccgggcgcgtgcacaccggcctggacgccctcggcgcggcagtcgacgcgggcgccccggtgcccgcccacgtcctggtgcaccacacccccgcggccaccaccgccgacgccgtccacgcggccacccacgaggcgctccgcctcgtccgggcctggctcgccgacgaccggttcgccgcgtcccgcctggtcttcgtcacccgcggcgcgatcgccacgcagagcgactgggacctcaccgacctgacccacgcccccgtgtggggactggtgcgcaccgcccagtccgagaaccccgaccggttcgtcctcgccgacctcgacgccgacccggcctcgacggacgccctcgccgcagccctcgccaccggcgagccgcagctcgcggtccgccgtggcaccgtccacgccccccgcctcgcccgcgtccccgccgccaccccgctgaccccgcccccgggcgagtccgcctggcgcatggacatcgaggacaagggaacgctcgaccacctcaccctcgtccccagcccggagtccgccgcgcccctggagcccggccaggtccgcgtcgccgtccgcgccgcgggcctcaacttccgcgatgtgctcaacgccctcggcatgtaccccggcgacccgggcctcatgggcagcgaaggcgccggcatcgtcgtggagacgggccccggtgtcaccggcctcgcacccggcgaccgcgtcatgggcatgctgcccggctcgttcggcccgctcgcggtcgtcgaccgccgcatgatcgcccccatgcccgagggctggaccttcgccgaggccgcgtccgtacccatcgtcttcatgacggcgtactacgccctccacgacctcgccggactgcagggcggcgagtccctcctcgtgcacgccgccgccggtggcgtcggcatggccgccgtccagctcgcccgccactggggcgccgacgtctacgcgacggccagccccgccaagtgggacaccctgcgcggactcggcctcggcgacgaccggatcgcctcgtcccgcaccctcgacttcgaggagaccttccgcacggccaccgggggacgcggcgtcgacgtcgtactcgactcgctggcccgggagttcgtcgacgcctccctgcggctcctgccgcgcggcggacgcttcgtcgaaatgggcaagaccgacgtccgctccccgcaggacgtcgccgacgcccacccgggcgtcagctaccaggcgttcgacctgaccgaggccggcctcgaccgcatccaggagatgctcaccgagctgctcaccctcttccgctccggcgccctgcgccccgtaccggtctccgcatgggacctgcggcaggcccccgaggcgttccgctacctcagccaggcacgccacgtcggcaagatcgtgctcaccctgccgggcgagtggaactcgcagggcaccgtcctcatcaccggcggcaccggcaccctcggcgcggtggtcgcccggcacgccgtcaccacccgcggcgcccgccgcctgctgctcaccagtcggcgcggcgaggccgccgccggcgccgccgaactcgccgccgaactgcgggaactgggcgccgaggtcacgatcgcggcctgcgacgccgccgaccgcgacgcgctcgccgcgctcatcgaatccataccgtcagagcacccgctgacggccgtcatccacaccgccggagtcctcgacgacggcgtcgtcgactcgctgacccccgagcgcctgtccacggtcctgcgcccgaaggtggacgccgcctggaacctgcacgagctgacccgtcacctcgacctggccgacttcgtcctgttctcctccgccgccggcaccttcggcggcgccggacaggccaactacgcggccgcgaacgtcttcctggacgccctcgcccgccaccggcacgcccacggcctcgccgccacctccctggcctggggcctgtgggccgaggccagcggcatgaccggcgaactcgacaccgccgacaaggaccggatgacgcgctccggcgtcctcggcctctcctccgaagagggcgtggcgctgctcgacaccgcacggctcaccggcgacgccctcctcgtccccatgcacctcgacctggcgccgctgcgccggaccgacgccagcatggtccccgccctgctgcgcggcctggtccgcgcccccgcccgcagggccgtcggagccaccgccgccggcgccggaaccccgctggtggagcggctcgtacggctccccgagaacgagcgcgacccgctcctgctcgacctcgtacgccagcaggtggccgccgtactcggccacgccacccccgacgccgtcgaacccacccgcgcgttcaaggacctcggcttcgactcgctgaccgccgtggagttccgcaaccggctcggcgcgaccgccggcatccggctgcccgccacgctcgtcttcgactaccccacccccacggtcctggccggctacctcaaggacgaactcctcggctccgaggccgcggccgccctcccgaagctcgccgccaccgccgtcgagggcgacgaccccatcgccatcgtcgccatgagctgccgcttccccggtgacgtccgcactcccgaggacctgtgggagctgctcgccgagggccgcgacggcatctccgacctcccggacgaccgcggctgggacaccgaggcgctgtacgaccccgaccccgacagccccggcacctcctatgccagggagggcggattcttctacgacgcccaccacttcgacccggcgttcttcgggatcaacccgcgcgaggccctcgccatggacccgcagcagcgcctgctgctggagacgtcctgggaggcgttcgagcgggccgggatcgacccgacgggcctgcgcggcaagcaggtcggcgtcttcgtcggccagatgcacaacgactacgtgtcccggctgaacaccgtccccgaaggcgtcgagggctacctcggcaccggcggctccagcagcatcgcctccggccgcgtctcctacaccttcgacttcgaaggccccgccgtcaccgtcgacacggcctgctcctcgtcgctggtcgccctgcacctcgcggcccaggccctgcgcaacggcgagtgcacgctggccctcgcgggcggcgtcaccatcatcaccacccccgacgtcttcaccgagttcagccgccagcgcggcctcgccagcgacggccgctgcaagccgttcgccgaggccgccgacggcacggcgtggggagagggcgtcggcatgctgctcgtcgagcggctctcggacgcccgccgcaacggccaccaggtcctggcggtcgtccgcggcaccgccgtcaaccaggacggcgccagcaacggcctgaccgccccgaacggcccttcccagcagcgcgtcatccgccaggccctcgccaacgcgggcctgaccgccgccgaggtggacgcggtcgaggcacacggcacgggcacccggctcggcgacccgatcgaggcgcaggcgctgctcgcgacctacggtcaggaccgccccgagggcagccccctgtggctgggctccatcaagtccaacttcggtcacacgcaggccgccgccggtgtcgccgggatcatcaagatggtccaggcgatgcaccacggggtgctgccgaagaccctgcacgtcgacgcgccgtccccgcacgtggactggtcggcgggcgcggtctcgctcctcaccgagcagatggcctggcccgaaaccggccgcccgcgccgcgcgggtgtgtcgtcgttcggcatgagcggtacgaacgcccacgccatcatcgaactcgccccggacgccgccaccccgagtgccgcccggccggagccggccccggccgccctcccgtggaacctctcggcccgcaccccggacgccctgcgcgcccagggcgagcggctgctgtcccacctggagacccactgtgagacccacccggagacggtgctcgccgacatcggccactcgctgacgaccggccgtgccctcttcgagcaccgcgcgacggtggtggcgggcgaccgcgacggcttccgcgccggactggccgcactcgccgaaggccggacggcggcgggcctgatccagggctcgtcctcgaccggcggtcgcacggcgttcctgttcacggggcaggggagccagcggctggggatggggcgcgagctgtacgaggcgtatcccgttttcgcgcgggctctggacgaggtgtgtgcccgtctggaactgcctctgcctctgaaggatgtgctgttcggtactgacacgggtctgctgaacgagaccgcgtacacccagccggcgctgttcgccgtcgaggtggcgctgttccggctggtggagagctggggcctgaagccggacttcctggcgggtcattcgattggtgagatcgctgctgcgcatgtggcgggggtgctctcgctggaggatgcctgtgctctggtgtcggctcgcgggcggttgatgggtgcgctgcctggtggtggcgtgatgatcgcggtgcaggcgtcggagggcgaggtcctgccgctgctgaccgaccgggtgagtatcgccgcgatcaacggtccgcagtcggtcgtgatcgcgggtgacgaggccgacgcggtcgcgatcgtggagtccttctcggaccgcaagtccaagcggctcacggtgagccacgcgttccactcgccgcacatggacggcatgttggacgacttccgggccgtggcggaaggcctgtcctacggggccccgcgcatcccggtcgtttcgaacctcaccggggccctggtctcggatgagatgggttcggcggacttctgggtccggcacgtccgtgaggccgttcgcttcctggatggcatccgcgccctggaggccgcgggcgtcacgacatacatcgagctgggccccgacggcatcctgtcggcgatggcccaggagtgcatcaccggcgagggtgcggccttcgcgcccgtcctgcgggcgggacgcgacgaggccgagacggtgctctccgcgctcgcggcggctcacgtccgcggcgttcccgtcgactggcaggccttctacgccccggccggagcacagcgcgtgcccctgccgacgtacgccttccagcgctccgtctactggctggacgcgggccgggcacagggtgacatcgcctccgctggactcggcgcgacggaccatccgctgctcagcgccgcggtcgaactgcccgactcggacggtttcctcttcaccggccgcctgtcgctggccacccacccgtggctcgccgaccacgcggtcctgggctccgtactccttccgggtacggctttcgtcgaactcgcgctgcgggccggtgaccaggtcggctgcgacctgatcgacgaactcactctcgaagcaccgctggtgctgcccccgcacggaggcgtccagctgcggctcgccgtcgcggccgccgacgcgacgggtcggcgcaccctggcgttccactcccggagcgaggacgcggacgccgggacgccgtggacccgtcacgcctccggtgtactcgcggtcggggccgagcggactccgcagagcctcaccgagtggccgccgaccggggccgaatccgtaccggtggacgggctgtacgagggcctggccgaatccggcttcggatacggtccggtcttccagggcctgcgtgccgcctggcggcgcgacggcgagtactacgccgaggtcgccctgcccgagggcacggaggacgaggccggacgcttcggcctccacccggccctgctcgacgcggcgctgcacgcgctgggtctgggcagcacggacaccgaaggcggcgaaggacggctgccgttctcctggtccggtgtgcacctgcacgccgtcggtgcctccgcgctgcgcgtacgtctcaccacgtcccgaagcggtgaggtggcgctgaccatcgccgacgcggccggagagccggtcgcgaccgtggccggcctcgcgctgcgggccgtgagccgcgagcagctgagcacggcacgggacctcacgcgtgacgcgctgttccgggtggactggactgcgttgcctgcgggcggtgccgtggggtcgctggacgactggatgttgttgggtgcgggttcgcaggtgtatgcggatctggcggggctgggtgtggctgttgcggagggtggtgggattccggcggcgttggtggtgccggtttcggagcctgatgcggagtctgctgcgggtggtgtggcgggtacggtgcacgcggctgttgagcgtgcgctgtctctggtgcaggagtggttgtcggacgagcggttcgcggatgcgcgtctggtgttcctgacgcggggtgcggtggctgcgcgggccggggacacggttccggggctggtgcaggccgctgtgtggggtctggtgcgctcggcgcagtcggagaatccgggtcgtttcgctctgatcgatgtcgacggcgacggcgacggtgacggtgaagtggacggggacgtgctgtcggccgcgctcgccaccggtgagcctgagctggcggtccgtgaaggggctttgctcgtgccgcgccttgcccgcgccgctgtcgttgagggtgccggtcgtgaactggatgtcgacggcaccgtgttggtcacgggtgcgagcggcaccctgggtggcttgttcgcccgtcatctggtggttgagcgtggtgtgcggcggctgctgttggtcagtcgtcgtggcgaggctgcggaaggtgctgctgaactgggcgccgaactcacggagctgggtgctgatgtgcggtgggcggcgtgtgatgtggccgaccgcgatgcgcttgaggctgtcctggccgggattcctgctgagtatccgttgtcgggtgtggtgcatacggctggtgtgctggacgacggtgtggtgtcgtccctgaccccggagcgcctctcggcggtgctgcgtccgaaggtggatgcggcatggaatctgcatgagctgacccgcggtttggatctgtcgctgttcgtgttgttctcttcggctgccggagtgttcggcggtgcgggtcaggcgaactatgcggcggcgaatgtgttcctggacgctctggcccagcaccgcagggcccagggcctggccgcgacctcccttgcctggggtctgtgggccggtgtgggcggcatgggcggtgagctgacggaatccgaccgcgagcgcatcaaccgcggcggcatcaccgctcttgagcccgagaccggtctcgccctcttcgacgcggcacagcgcaccaccgacgcactgctcgtccccctcccgctcgacctggccgccctgcgcgtccaggccggcagcggaatgcttccggacctgctgcgcggcctggtccgcgtaccggtgcgccgggcggcggggcagggaagcgcggccgggggcgggtcggtactccgtacccgactggctgcgatgcccgccgatgagcgggacgcggccctgctggacctggtccgggccgaggtggcggccgtactcggccacgcgtcgaccgacgaggtaccggccgaccgggcgttcaaggagctcggcttcgactcgctgacctcggtcgagctgcgcaaccgcctcggcgccaccacgggtgaacggctctccgccaccctcgtcttcgactacccgaccccgcacgcgctcgccgagttcctgcgcaccgaggtgctgggcctggacgagccgacggatacggccacgaccgcccccacgcacctcgggacatcgctcgacgacgacccgatcgcgatcgtcggcatgagctgccggtaccccggcggggtcgagacccccgaggacctctggcgcctggtggtgggtggcggcgacgccatctcggagttcccgcagggacgcggctgggaccttgagtcgctctacgacccggacccggacggcaagggcaccagctacacccggtcgggtggcttcctgcacgacgcgggccggttcgacccggcgttcttcgggatctcgccgcgcgaggccgtggcgatggacccgcagcagcggctgctcctcgaaacctcgtgggaggcgttcgagcgggccgggatcgacccggcctcgatgcgcggcagccggaccggtgtcttcgcgggcatcatgtaccacgactacgcgacccggatcacctccgttccggacggggtcgagggctacctcggcaccggaaactccggcagcatcgcctccggccgcgtctcgtacgccttcggcctggagggcccggcggtcaccgtcgacacggcctgctcgtcctcgctcgtcgccctgcactgggcgatccaggcgctgcgcaacggcgagtgcacgatggcgctggccggcggtgtcaccgtcatgtcgacgccgggcaccttcaccgagttcagccgccagcgcggcctggccgccgacggccgcatcaagtccttcgcggccgcggccgacggcaccagctgggccgaaggcgcgggcatgctgctcgtagagcggctgtcggaggcgcgggccaagggccacccggtcctggcgatcgtgcggggctcggcgatcaaccaggacggtgcgagcaacggcctgaccgctccgaacggtccctcgcagcagcgggtgatccgccaggccctcgcgggggcccggctgaccagtgaccagatcgacgtggtggaggcgcacggcacgggcaccaccctcggcgacccgatcgaggcgcaggcgctcctggccacgtacggccgcgagcgcgaggcggaccagccgctgtggctgggctcgatcaagtccaacatgggtcacacgcaggcggccgccggtgtcgcgggcatcatcaagatgatcatggccatccggcacggtgtgctgccgaagaccctgcacgtcgacgagccgactccgcatgtggactgggaggccggtgcggtctcgctcctcaccgagtccgtcccgtggccggagacgggccgtccgcgccgcgccggtgtgtcgtcgttcggtatcagcggcaccaacgcgcacacgatcatcgagcaggcgccggaggagttcgtcccggtccgtgtgaccgagtcgcagacgccgggcgcgggttcgcgagtgctgccgttcgtgttgtccgcgaagtcggcgggggcgttgcgtggtcaggcggtgcgtctgaaggcgcatgtggaggcttcgccggaggtgtctggagccggggccgttgatgtggcgtattcgctggcgacgcggcgtgcggtcttcgaccaccgtgcggtggtggtggccggtgaccgcgaggagttgctgcgttctctggctgctgtggagtcggagggcgcggcggctggtgtgacccgtggggccgtgggtggcggaaagcttgccttcctgttcacgggccaggggagccagcggctcgggatgggccgtgagctgtacgagacgtatcccgtcttcgcgcgggctctggacgcggcgtgtgctcgtcttgaactgccgctgaaggatgcgctgttcggcaccgatgcgggtctgctgggcgagacggcgtacacccagccggctctcttcgcggtcgaggtggcgttgttccgactgctggagagctggggtgtgaggccggacttcctggcgggtcattcgatcggtgagatcgcggccgcccatgtggccggggtgctctccctcgatgacgcctgcgcactggtcgaggcgcgtggtcgtctgatgcaggcgctgccgaccggtggcgtgatgatcgccgtccaggcgtctgaggctgaagtcctgccgctgctgaccgaccgcgtgagtatcgccgcgatcaacggtccgcagtcggtcgtgatcgcgggtgacgaggccgacgcggtggcgatcgtggagtccttctcgggccgcaagtccaagcggctcacggtcagtcacgcgttccactcgccgcacatggacggcatgctggctggcttccgcaaggtggcggagagcctgtcgtacgaggctccgcgcatcccggtcgtctcgaacctcaccggggccctggtcaccgacgagatgggttcggccgacttctgggtgcggcacgtccgcgaggccgtccgcttcctggacggtatccgcaccctggaagccgcaggcgtcgcgacgtacgtcgaactcggccccgatggcgtcctgtcggcgatggcccaggactgcgtcaccggcgagggtgcggccttcgcgcccgccctccgcaagggccgccccgagaccgagacgatcaccacggccctcgcccttgcccacgcccacggcacgtccgtcgactgggagacgtacttcgccgggaccggcgcccagggcgtcgagctgccgacctacgccttccagcgtgactggtactggctgaactcggccgtggtgcaggccggtccgggcgacgcgagcggattcgggctcggcgcgaccgatcaccccctgctcgacgcgaccatcgaactgcccgactcggacggcttcctgttcaccagcaggctgtccctcgacacgcagccgtggctcgcggaccacgccgtcctggggtcggtcctcctcccgggcacggccttcgtggaaatcgccgtacgggcaggtgaccaggtcggttgcgacgtactggaagagctgacgctggaggcaccgctggtggtgcccgagcggggcggtgtgcagctgcggctcaccgtcgccgccgccgacgagtcgggacggcgaggtctgtcgctgtactcccgcgacgaggacgctcccgccgacgagccgtggacgcgccacgccagcggcgtgctcgccaccggcgcggcggcccccgacttcgacctcgccgcctggcccccggccggagccgaaccggtcgacatcgacggcctgtacgagggcctggccgcggccgggttcgactacggtccggccttccagggcctgcgcacggcatggctgcacggcgacgcggtgtacgccgaggtgagcctggacgaggagtccgcggaatcggcggaatggttcgggctgcacccggccctcctggacgcgacgctgcacgcggcgggtctcggcggtctcgtggagagcaccggccagggacggcttccgttcgcctggagcaatgtgtccctgcacgcggccggcgcgtccgcggtacgggtccggctggccccggccggccgtgacgcggtgtctctgcagctcgccgacgcggcgggcgcaccggtcgcctcggtcgaatcgctggtgctgcgggcggtctcgcccgaccagatcggcgcggcgcgcggcggccgtcacgagtcgctcttcgagatcgactgggccgccctcccgctcgccccggtgtccgctgccgaacagcgcccctgggcgctgctggcggacgacgggtccggccacgcgggactcgaagccgtgggtgtccgtcacgaggcccacaccggactcgcggcgctcgccgacaccggacgggcgatccccgaggtcgtgtgcgtcccgctcgctgcggcgaactcccaggacctggcgggtgcgggtgcggtgcacgcggctgtggagcgtgcgctgggtctggtgcaggagtggttgtcggacgagcggttcgcggatgcgcgtctggtgttcctgacgcgcggtgcggtgtccgcggtgccgggcgaggacgtgaccgatctggtccacgctccggtgtggggtctggtgcgttccgcgcagtccgagaacccgggccgcttcgtcctggccgacaccgacggcaccgacgcctcctaccgtgccctgacggccgcgctcgcctcgggcgagccggagttcacggtgcggggcggcgcggtacgggtgcccaggctgacgcgctccactgctgtcgctgtggaggctgtgcccgaactcggttcggacggcacggtgttggtgacgggtgcgagtggcacgttgggtggtttgttcgcccgccatttggtggttgagcgtggtgtgcggcgcctgctgttggtgagtcgtcgtggtggggctgcggagggtgctgctgaactgggcgccgaactcacggagctgggtgctgatgtgcggtgggcggcgtgtgatgtggccgaccgtgatgcgcttgagtccgtcctggccgggattcctgctgagtatccgttgtcgggtgtggtgcatacggctggtgtgctggacgacggtgtggtgtcgtccctgaccccggagcgcctctcggcggtgctgcgtccgaaggtggatgcggcatggaacctgcacgagctgacccgcggtttggatctgtcgttcttcctgttgttctcgtcggctgccggtgtgttcggtggtgccggtcaggcgaactatgcggcggcgaatgtgttcctggacgctctggcccagcaccgcagggcccagggcctggccgcgacctcccttgcgtggggtctgtgggctgagccggggggcatggcgggcgcgctggacgctgatgatgtgtcgcgtctgggccgtggcggtgtcagcgggctctccgcgcaggagggtgtggcgttgttcgacgcggcgtccgcctccgaacaggccctgttcgttcccgtgaagctggacctggccgccctgcgcgcccaggcgggtagcggcatgcttccgccgctgctcagcggtctcgtccgtacccccacccgccgcgccgcgggcaccggcggcaccggagacaccggcacggacggtgggaccgcgctgcgggagcgcctggccgggctcgcaccggccgcgcgggacgaagcgctgctggagctcgtctgcacgtacgtcgcggcggtgctcggcttcgccgggcccgaggcggtcgatccggcgcggtcgttcagcgaggtcggcttcgactcgctgaccgccgtcgagctgcgcaacaggctcggcgccgcgaccggcgtacgcctccccgccaccctcgtcttcgactacccgacaccggacgcgctggtggagtacctgcgcgacgaactctggcaggacggcgccgcggcggtacccccgctgctcgccgaactcgaccggctggagaagacgctcgtggcgtccgtgcccgacgacgacggccgcacccgcatcaccgagcggctgcaggccctgctggccgcctggagcgaggccggcgaatcaacggacaccgccgacgccgatgtggccgaggcgcttgagaccgcgaccgacgatgacctcttcgacttcatcggcaaggagttcgggatctcgtgatgcgaaggcccggctccgccctttccgacggctctgtctttctggcttctgtacgagggatgcacgcatgaatgaggaaaaactccggtacttcctgaagcgggtgacggccgatctccacgagacgcgccggcgtcttcaggaggtcgagtcggaggagcaggagccgatcgcgatcgtcgggatgagctgccgctacccgggagacgtcgagtcgcccgaggacctgtggcggctggtgtccgaggagaccgacgccatctcccctttccccaccgaccggggctgggacatggggcggctcttcgacgcggaccccgacgggcggggcacgagctatgtgcaggaaggcggcttcctgcactccgccaaccggttcgacccggcgttcttcgggatctcgccgcgcgaggccgtggcgatggacccgcagcagcggctgctcctcgaaacctcgtgggaggcgttcgagcgggccgggatcgacccgacctcgctgcgcggcagccggaccggcgtcttcgcgggcgtcatgtaccacgactacgcctcgcggctgcgtgccgtcccggaggaggtcgagggttacctcggcaccggcggctccagcagcatcgcctccggccgggtctcgtacaccttcggcctggagggcccggcgctcaccgtcgacacggcctgctcgtcctccctcgtcacgctgcacctggccatgcaggcgctccgcaagggcgagtgctcgctcgccctcgcgggcggtgtcaccgtgatggcgacaccgggcaccttcacggagttcagccgccagcgcggtctgtccttcgacggccgctgcaagtccttcgcggactccgcggacggcaccggctgggccgagggcgcgggcatgctcctcgtggagcggctctcggacgcccgtaagaacggccatacggtactcgccgtggtccggggctcggccgtcaaccaggacggtgccagcaacggcctgaccgccccgaacggcccctcccagcagcgggtcatccggcaggccctggccgacgcccgcctcacggcggccgacgtcgacgtcgtggaggcacacggcaccggcaccaccctcggtgacccgatcgaggcgcaggccctgctcgccacgtacggccgggaacacaccgaggacagcccgctgtggctcggctcggtcaagtcgaacctcggtcacacccaggcggccgcgggcgtcgccggcatcatcaagatggtcatggcgatccgccacggccggatccccaagacgctgcatgtcgacgagccgtcgaccaacgtcgactggtcggcgggcgccgtctcgctgctgcgggagtccgtggagtggccggagaccggccgcccgcgccgcgcggcgatctcttccttcggcatcagcggcactaatgcgcacacgatcatcgagcaggctccgctgccggaggccgagaccgaaaccgagccgaccggcgacgagacggacggctctgagagcacggcgggggcagaggggacagaggggacagagggcgccggggtgcggcccgtgtccgtgcctcccgtccttccgtggcccgtctcggcccgtacggaggaggccctgcacgcccaggcggaacgcctgctggcccacgtgcggaccaacccggaccaggccccggtgggcgtcgctctctccctggccacagggcgcgccgcgctggaacaccgcgccgttgtcgtcgccaccgaccgggaaaccgccctcgccgacctcgccgcactggcgtccggcgagacctcggcgcgcgtcgtgctcggcgagccgggagcgcggggcaagaccgcgttcctgttcacggggcaggggagtcagcggctggggatggggcgcgagctgtacgaggagtatcccgtcttcgcggatgcgctggacgcggtgtgtgcccgtcttgaactgcctctgaaggatgtgttgttcggggcggatgcgcgtctgctggacgagaccgcttatacgcaaccggcgctcttcgccgttgaggtggcgttgttccggttggtggagagctggggtctgaagcccgacttcctggccgggcattcgatcggcgagatcgccgccgcgcacgtcgcgggggtgttctcgctggaggatgcttgcgcgctggtgtcggctcgtggccggttgatgggtgccctgcctgcgggtggcgtgatgatcgcggtgcaggcgtcggaggacgaggttctgccgctgctgacggcccgggtgagcattgccgcgatcaatggtccgcagtcggtggtgatcgcgggtgacgaggccgacgcggtcgcgatcgtggagtccttcacggggcgtaagtcgaagcggcttacggtcagtcacgcgttccattcgccgcacatggacgggatgttggaagacttccgggtcgtggcggaggggctgtcgtacgaggctccgcgcatccccgtcgtttcgaacctcaccggggccctggtctcggatgagatgggttcggcggacttctgggtccggcacgtccgtgaggccgttcgcttcctggatggcatccgggccctggaggccgcgggcgtcacgacgtacgtcgaactcggccccgacggtgtcctgtcggcgatggcccaggcatgcgtgaccggcgagaactccgtcttcgtgccggtcctgcgctcgggtcgctccgaggcggagagcgtcaccacggcccttgcccaggcgcatgtccgcgggatcgccgtggactggcaggcctacttcgccggtaccggtgccgagcgcgtcgacctgcccacctacgccttccagcgcgaccactactggctcgacgccggaacgctcggcggagacgtgaccacggcgggccttcgatccgccgatcaccctctgctcggcgcctctgtggctctggcggatgcggagggccttctcctcaccggccggctctcgctcgacacccacccgtggctcgccgaccacgctgtggcggggacggtcctgctgcccggtacggcgttcgtcgaactcgcgctgcgggccggtgaccaggtcggctgcgacctgatcgacgaactcaccctcgcggcgccgctggtgctgcccgagcagggtggagtcgaactccagatcaccgtcgcggcccccgacgaatcgggccgccggtccgtcgccttccactcgcgcgccgacagcgccgcggacgacgaggcgtgggtccggcacgcgaccgcagtactggccgagggcgcggacaccccggtgttcgacttcggcgtctggccgccgaccggggctgaatccgtaccggtggacgggctctacgaggggctcgcgcactccggattcggctacggtcccgtgttccaggggctgcgtgccgcctggcgccagggcgaggacgtgttcgccgaagtgagcctcggggacggggtcgagcccggagcagcgcacttcaccgtgcacccggccctgctcgactccgccctgcacgccatcaacctcggcaccctcgtcgaggacaccggccaggggcgactgccgttcgcatggagcggggtcgcggttcacgccgtgggggcggacaccctgcgcgtacggctctcccgggccggtcaggacgcggtggccctggagatcgcggacgcggacggcgcgcccgtcgcttccgtacgcagcctggccctgcgcgccttctcacccgaccagctgaccgggccggacggcgccggtcacggcgacgcgctgttccgggtggactgggcggcgttgcctgcgggcggtgcggtcgggtcgctggacgactggatgttgttgggtgctggttcgcaggtgtatgcggatctggcggggttgggtgtggctgttgcggagggtggtgggattccggcggcgttggtggtgccggtttcggagcctgatgcggagtctgctgcgggtggtgtggcgggtgcggtgcatgcggctgttgagcgtgcgctgggtctggtgcaggagtggttgtcggatgagcggttcgcggatgcgcgtctggtgttcttgacgcggggtgcggcggctgcgcgggccggggacacggttcccgggctggtgcaggcggccgtgcggggtctggtgcgctcggcgcagtcggagaacccgggccgtttcgctctgatcgatgtcgacggcgatggtgaagtggatgcggaggtgctgtcggccgcgcttgctacgggtgagcccgagctggcagtccgtgaagcggctttgctcgtgccgcgccttgcccgtgccgctgtcgcggtggagcctgcgcccgaactcggttcggatggcacggtgttggtgacgggtgcgagtggcacgttgggtggtttgttcgcccggcatttggtggttgagcgtggtgtgcggcggctgctgttggtcagtcgtcgtggtgaggctgcggaaggtgctgctgaactgggcgccgaactgactgggttgggtgctgatgtgcggtgggcggcgtgtgatgtggccgaccgtgaggcgcttgagtcggtcctggccgggattcctgccgagtatccgttgtcgggtgtggtgcataccgctggtgtgctcgatgacggtgtggtgtcgtcgctgactgccgagcgtgtgtcggcggtactgcgtccgaaggtggacgcggcgtggaacctgcacgagctgacccgtggcctggatctctcgctcttcgtgttgttctcgtcggctgccggtgtgttcggtggtgccggtcaggcgaactatgcggcggcgaatgtgtttctggacgctctggcccagcaccgcagggcccagggtctggccgcgacctctcttgcgtggggtctgtgggatgagccggggggcatggcgggcgcgctggacgctgatgatgtgtcgcgtctgggccgtggtggtgtcagcggactctccgcgggggagggtgtggcgttgttcgacgctgcgtccgcgtccgaacaggccttgttcgttccggtgaagctggacctggccgccctgcgtgcccaggcgggcagtgggatgttgccgccgctgctcagcggtcttgtccgtacccccacccgccgcgccgcccggggcggttcggccgcggggggaacgttcgcccggaagctggccggcctcgcggtggaccagcggtccgcagccgtgatggagctcgtgcgtgctcaggtcgcagccgtgctcggccttgccgggcccgaagcggtagacccggcacggtcgttcagcgaggtcggcttcgactcgctgaccgccgtcgagctgcgcaacaggctcggcgccgcgaccggtgtacgcctccccgccaccctcgtcttcgactacccgacctccctcgccctcgccgacttcctgggtggcgaactgctcggcggtcaggaagcggcagcagccccgacggccttcacggcccgggacgacgagccgatcgcgatcgtggcgatgtcttgccgtttccccggcggcgtgcggtcgcccgaggatctgtgggggctggtcctggacggccgggatgccatctcggacatgccggacgaccgcggctgggacgtcgagggactcttcgaccccgaccccgaccgcccgggcaccagctacagcagggcgggcgggttcctgcacgacgcccaccacttcgacccgacgttcttcgggatctcgccgcgcgaggccctcgccaccgacccccagcagcggctgctcctcgaaacctcgtgggaggcgttcgagcgggccgggatcgatccggccaccgtacgcggcagccggaccggcgtcttcgcgggcgtcatgtacaacgactacggcaccctcctgcaccgcgccccggagggcctcgaaggctatatgggcacctccagctcgggcagcgtcgcctcgggccgggtctcgtacaccttcggtctggagggcccggcggtcaccgtcgacacggcctgctcgtcctcgctcgtcaccctgcacctcgccgtgcaggccctgcgcaacggcgagtgcgacctcgcgctggccggcggtgtcacggtgatggccacgcccggtacgttcgtcgcgttcagccgtcagcgcggcctcgcgagtgacggccgctgcaagccgttcgccgcggccgccgacggtacggcgtggggcgagggcgtcggcatgctgctcgtcgagcgcctgtcggacgctcgggccaagggccacccggtgctcgcggtggtccgtggctcggcgatcaaccaggacggtgccagcaatggcctgacggctccgaacggtccctcgcagcagcgggtgatccgccaggcgctggccagtgccggtctgtcggcggcggatgtggacgtagtggaggcgcacggcaccggcaccaccctgggcgacccgatcgaggcgcaggcactcctcgccacctacggtcaggagcacacggacgacagcccgctgtggctggggtccatcaagtccaacttcggtcacacgcaggccgctgccggtgtcgcgggcatcatcaagatggtgcaggcgatgcaccacggggtcgtccccaagacgctgcacgtggacgagccgtccccgcacgtggactggtcggcgggcgcggtctcgctcctcaccgagcagatggcctggcccgaaaccggccgtccccgccgcgcggcgatttcttccttcggtatcagcggtaccaacgcgcacacgatcatcgagcaggcgccggaggagttcgctccggtccgtccggtccgtgtgatcgagccggaggcggtgggtgcgggttcgcgggtgctgccgttcgtgttgtccgcgaagtcggcgggggcgttgcgtggtcaggcggtgcgtctgaaggcgcatgtggaggcttcgccggaggtgtcgggggccggggctgctgatgtggcgtattcgctggcgacgcggcgtgcggtcttcgaccaccgtgcggtggtggtggccggtgaccgtgaggagctgttgcgtgctctggctgctgtggagtcggagggcacggcggctggtgtgacccgtgggacggcgggtggcggaaagcttgccttcctgttcacgggccaggggagccagcggctggggatggggcgtgagctgtacgagacctatcccgtcttcgcgcgggctctggacgcggcgtgtgctggtctcgaactgccgctgaaggatgcgctgttcggcgccgatgcgggtctgctggacgagacggcgtacacccagcccgctctcttcgcggtcgaggtggcgttgttccgactgctggagagctggggtgtgaggccggacttcctggccgggcactcgatcggtgagatcgcggccgcgcatgtggccggggtgctgtccctggacgacgcctgtgcgctggtcgcggcccgcggccggctcatgcaggcgctgcccaccggcggtgtgatgatcgccgtccaggcgtcggaggacgaggtcctgccgctgctgaccgaccgggtgagcatcgccgcgatcaacggtccgcagtcggtcgtgatcgcgggcgacgaggccgacgcggtggcgatcgtggagtccttctcgggccgcaagtccaagcggctcacggtcagtcatgcgttccactcgccgcacatggacggcatgctggctggcttccgcaaggtggcggagagcctgtcgtacgaggctccgcgcatcccggtcgtctcgaacctcaccggggccctggtcaccgacgagatgggttcggccgacttctgggtccggcacgttcgcgaggcggtccgtttcctggacggtatccgggccctggaggccgcgggcgtgacggcgtacgtcgaactcggtcccgacggtgttctgtcggcgttggcccaggagtgcgtcaccggcgagggtgcggccttcgcgcccgccctccgcaagggccgccccgaggccgagacgatcacaacggccctcgcccttgcccacaaccacggcacgtccgtcgactgggagacgtacttctccgggaccggcgcccagcgcgtcgacctgcccacctacgccttccagcgcgagcgctactggatcgacgtgcccgtccactccgtcggcgacgtggcctccgccggactcggtgcggcggagcacccgctgctgggcgcggccgtcgaactgcccgactccgacgggctgctgctcaccggtcggctgtcgctcctgtcgcacccctggctggccgatcacgccgtcgcgggcaccgttctgctccccgggaccgccttcgtggagctggcgctccacgccgggcagcgggtgggcagtggcctgctcgaagagctgaccctggaggcgccgctggtgcttcccgagcgcggggcgctccagctgcgggtgtccgtggccgcgcccgacgaggcggggcgtcgtgcgctgcacgtgcactcgcgtcccgaggacctgggcggcgaggaccgtacggggcacgaggtgccgtggacgcggcacgccggcggtgtgctcgccgcgccggaggcggccggtgccgcgccggaggagtccggcctggacgtctggccgcccgcggacgccgaaccgctcgatgccggcgacctgtacgaccggttcgccgagggcgggttcgcgtacggtcctgtcttccgcaacctgcgcgctgcctggcggcgcggcgacgagctgttcgccgaactgctcctgcccgaggggcagctcgcccaggccggccacttcggtgtgcacccggcgctgctggacgcgggtctgcacggcctcgcgctcggctcgttccatgacggtgcggacgaggacgcccggatccggctcccgttctccttcagcggtgtcgctctgcactcggtcggcgcgggctcgttgcgcgtacggctcgccccggccgggtccggcgcggtgtcgctcgcggccttcgacgagcagggcgcaccggtcgtgtcggtggaatcactgctgctgcgggcggtggatccggcacggctgaaggccgcggaacagccggtgttccacgagtcgctcttccggctggagtggccggcgctggccgcgggcccgcgtacggacaacgcccccggggacggcggccggtgggccgtggtcggggccgactcgctcggccttgaggccgggctgcgggcggacggcgtcgccgtcgacgggtacgcggacctgtccgcgctcgccggagtcgtggccgcgggcaagccgcagccggacacggtgctggtctcgtacgcctcctcgggtcccggcatcaggacggcggacgccgttcggcaggcggctcacgacgcgctggagctggtccagggctggctcgccgaggagtcgctcgccgggtcacgactggtcgtggtcacccgcggcgcggtcgaggcgcggcccggcgagggcgtgcccgatctggcgcacgcggcggtgtggggcctgctgcggtccgcgcagtccgagaaccccgggcggttcgtactgctcgacctcgacgcggaagacgcggaggtcctggctccgctgatggccgccgctgtggcgagcggggaaccccagctcgccgcccgcgagggcgtcctgcatgccgcgaggctggcacgggttcccgccgcccccaccgcggtggcgggcacggagcgcgcgcccgccctcgaccccgacggtacggtcctcatcaccggcggcaccggatcgctcggcagcctgctggcccgccacctggtcgtggagcacggcgtacggcacctgctgctgaccagccggcgcggtgccgccgccgagggcgccccggaactcgtcgccgcactggccgaactgggcgccgaggcgaccgtcgccgcgtgtgacgccgccgaccgggaggcgctggccgcgctgctggccggcattccggccgcgcaccccctcacggccgtcgtccacacggcgggccgcgtcgacgacgggctcctggcgtcgctcagcccggagcggatcgacacggtgctgcgtcccaaggccgacgcggcgctgcatctgcacgagctgacccgcgggctggacctcgccgcgttcgtcctgttctcctccgcggccggaaccctcggcaaccccggccaggccaactacgcggcggccaacgccttcctggacgccctggcacagcaccggcgcgcggcggggctgcccgcggtgtcgctggcctgggggctgtgggagcagcgcagcgcgatgaccggagcgctgtcggacgcggacgtccagcggatggcacgcgccggactcgcgcccctctcctcggcggagggcctggccctcttcgacacggcgtgcgccctcgcgccggtgggcgccacggagaccgccaccggcgacggagcgttcgtcgccatgcggctggacaccgcgcccctgcgggcccaggcggacgccggagcccttccggcggtcttccgcgggctggtgcgcggaggtcctcgcagggccgccgcacatcaggccgccgattcggcggcatccactgccgcgcgaaagctcgcgggcctgtccgggctgccgcaggacgagcaggagcgcgtgctgctcgacctggtgcgcgcccaggtggccgccgtactcgcctatccgtcgccggacgcggtgggggagtcgcaggagttcctggagctgggtctggactcgctgaccgccgtcgagctgcgcaaccagctgaacgcggcgaccggcctgcggctgcccgccaccctgctcttcgaccaccccactcccgcgctggtcgccgagcggctgcgcgccgaactcgccggagcctccggcccggcggcggtccgggagggcgcggcggacagcggcgcggagggctccgcgggtgtcttcggggccatgctccacgaggccggaacgcagggtgcgtccgggcagttcatggagctgctcatgcaggcgtcgcggttccggccgtcgttcgcctcggcggccgagctgcgcaaggcgccgagcctcgtgcggctctcccgcggtgacacccggccgggactggtctgtttctcctcgatcctgtcgatctcgggcccgcaccagtacgcgcgcttcgcctccgcgttccggggccgccgggacgtgcacgcgctcggtgcccccggcttcctgcggggcgagcagctgccctcggccaccgacgcggtgatcgaggcccaggcggaggccgtgctccggcacgcggacggtgcgccgttcgtcctcctcggccactcctcgggcggcatgctcgcccacgcggtggccgggaggctggagagcgagggggtcttcccccaggcgctggtgatgatcgacatctactcgcacgacgacgacgcgatcatcggcatccagcccggcctctccgaggggatggacgagcggcaggacacctacgtaccggtcgacgacaaccggctgctggcgatgggcgcgtacttccggctgttcggaggctggaagcccgaggtggtgaagacgccgaccctgctggtccgggcgggtgagcggttcttcgactggacccggtccacggacggcgactggcgttcgtactgggacctggaccacacggccctggacgtgccgggcaaccacttcaccatgatggaggagcacgctccgacgaccgcacaggccgtcgaggggtggctggacacgaccggctgacaccaccggctgacggcgccggacagcgacatggccgggcgtcaagcgtcagacgtcaggcgacgcgcttctcacgctcgcgggagcgcttcttcggcagccccaccgtcacgacctcgaagctgtccttggtgaggtcgaggcggtggaagaggttgtcgggcccggtcacgcacaccgtgcccacgccgagccccttgagggactccaccacgcccggccagtggacgggccggtcgaaggtgtccagcatcatcgtgcgcatcccggcggcgtcccggacgaccccgccgtcctggtcgttgaccacgggcagggtggggtcggccagttcgtacgcggcgaagacctcttcctccgccttgcggcgcagcgccgagaaggccgccgcgtgcacgggcgggcgcatcgagtacatggagtagccgccgaccgcgctgatgcccgccttcagcccgtccagctccttctcctgtacggacaccatgtggaaagcggcgtccagccgcccggagatgtcgtaccaggcaccgcggtcgtcgaagccggccaggatctcgtccagccggtcctgcggggtgcggacgaagcagtgcgtgacgacgtcctggtacgcgtcggcgaagtactcctcctcgcagcgggccagctccgcggtgagccggacgacgtccgcgaagggcagcgacccgacgaaagcggaggcggccttctggccgaaactcgggccggcgcagacggtgggagagatgccgagcgcgtccaccgcccggtcggccatagccatcgaattcaccaggaaggcgatctgcgaatagaccgagtagtcgtcctcggaggtgcggaaacggtcgaacaccgaatatccgagcgcctcgtctgcctccgcgaggcgccggcgcgcgtaagggtcgagcagcaggaactttccgacctccgcgaaggacgaggggcccataccgggaaagacgatcgccgtctcggtcgagggagtctgctcggagtcgaagccggagttgaagccggagtcggagccggaacgggagtcggaacgggaatcagaagtggtcatgatccgtgaatgcctttgcttccggggacggcaccggcaggcacctgccgccgtcacgaacgtaggaacggccccgcacccggccggacgcgaatgcgccgagccgggcacgaggccaggagggacgagaggggggagacgagagaggggagaccagacggggcagcgcgcgctcagtcctgcgcctcagtcctgcgccctgcggtggaaccccttgatgccgatcagcccgaagaccacgatcgccccgctcagggcgagcagatcgatccacagcggaatcgagccggggccgcccggcggcagcagcagggcgcggatcccctcgctgacgtaggtcagcgggttgatggcgcacagcacctggaaccagcggatgtccgccaggctgtgccaggggaactgggtgcagccggtgaacatcagcggggtcagcgtcacggcgaagatgacgctgatgtgccgcggcggggccagcgtgccgatggtcagacccaccgtgctgcccgccagcgcgcccgtcagcagcacgcccagcgtgggcaggaagctgtccatcggccaggacacgtcgtcgaggatcaggaagccgacggggatcatcaccagtgaggcgatgatgccgcgcagcgccccgaagaccagcttctcgacggccaccaggctggtggggatgggcgcgaggagccggtcctcgatctccttggtccaggagaagtcgatgaccaggggcagcgcggtgttctgcaggctgaccaggaagctgttgagcgcgaccacgcccgggagcaggatctgctggaacccgccgccggtgtaaccgagttcgccgaggaccttgccgaagacgaacaggatgaagaacggttccacgagcacctgggcgaggaacgggcccagttcgcggccggtgacgaagatgtcccgccacaggatgaagaagaacgtgcgggtcgcggtgcgcacgtcggtgcgcgcgggccgcagttcggccgggaagtcggtgaccgggtcgggtgcggtcagggtggccgtcatcgcagctcccggccggtgagcttgatgaagacgtcctccagggtcgcggttccgacgctcacgtccttgatgtcgtgactcgcttccgtcagggccgtgatggcggtcggcagcaccgcgccggacggcgcgtcgctgtagaggcggagccgtaccggcgcgggcgcgccgccctgctccttggcgtgttcctggtgtgccagctcgacccgctcgaccgtctcgatccgctccagcaggcgtacgacgctctcggcgtcgtgccccgcgggctggacggtgagggtgagggcggtgctgctcaggctccgggtcagcgcctgcggggtgtcgagggccagcagtcggccgtggtcgacgatgccgacgcggtcgcagagcttggcggcttcgtccatgtcgtgcgtggtcagcacggtggtcaccccgcgcttgctcagctcggccacgcgctcgtggatgaacagccgtgcctgcggatcgagtccggtggcgggctcgtcgaggaagagcacgtcggggcggtgcatcagggcccgggcgatcatcacgcgctgggcctggccgccggagagttcgtcgccgcgggccttgccccggtcggcgagacccacccactccaggcactcgtcggcgagccgtccgcgttcggagcggctcatgccgtgatagccggcgtggaaggtcaggttctgccggagggtcagcgaccggtcgaggttgttgcgctgcggtacgacggcgaaggcccggcgcgcctgggcggggtgggccacgacgtcgacgccctggacgaacgctcgccccgccgtgggggccacgcgggtggtgaggatgccgatggtcgtcgtcttgcccgccccgttcgggccgaggaatccgaagacctcgcccctgcggaccgagaagctcaggtcgtccaccgctggtcggtcgcggctccggtacttcttgactagtccgtcgaccacgacggcggaatccacgggtcgttcagagttcatttacgcctgcgaatcaagcgggacgcggcgacggcagtccgggggattcgcacaggaatgtcgcgtgaccggccgcgcgtcgagcgccgactgaatagggcataggagtggtgcggaatctttctagcgcgcaggacggcgcgttgccccaactggccaatcggttagggggagatgcggaatcctagggggggatagggggtgaggcggcgaatcggggccatttgggggtgctggtcggacaacccctattcgaaaggatccggggtggcgagtgttgcggttccgtcgaatgtcctcatagcatcggcgcgtgatcgcgccgaattattcttcgcaaaaaagagcgtcggcgggtcgtgtgtccgcgggctttggggtggaacccgggtcgctgcggtggatggtgatcggcgcgacgggcatgctcggcggcgaagtggccgcccagctcacggcccggggcgccgacccggtgggggtcggcagtgcggatctggacctcaccgacccgcaggcggtcgccgcggccgtggccgacggcggccccgatgtcgtcgtcaactgcgccgcctggaccgccgtggacctggccgagaccgaggaggaggcggccctcgccgtcaacgggacgggagcgggccacctcgcccgggcctgcgccgccaccggcagccggctcctccacgtctccaccgactacgtcttccgaggtgccccggccgatgccggacacccctatgcggaggacgccgaacccgaccccgccaccgcgtacggacgcaccaagctcgtcggcgagcgcgccgtcctcgccgaactccccgccaccgctgccgtggtgcgcacgtcctggctgtacggacgcgacaacggcggcttcgtgcacaccatggcccggctcgcgcgcgagccgggacgcaccgtggacgtggtcgacgaccagcacggacagccgagctggacccccgatgtcgcggcccggatcatcgagctcgccgccctgcccgccgaccgggcgcacggcgtcttccatgccaccggcgggggccgcaccacctggtacgacctggcccgcgaggtgttccggctgaccggccaggacccggaccgggtccggcgcatcgacagctccgggctgcgacgggcggcggtccgcccggcatggagcgttctgggccatgaccgctgggccgccacggggctcgccccgatgcgtcactggcgcacggccctcgcggacgccctcatgggcgaccccgtgggcgaccgacttcccgagagtgtgaactcccccggcccgaaaggctgttgaagggtgaaatccctgtcgatagagggcgcctggctctatgagccgctgctccacgacgatgagcgcggcacgttcctggaggtgttccagagccaggccttcgagctggccaccggccgccgcctcgaactggcccaggtcaactgctccgtgtcccgccgcggcgtcgtgcgcggcgtccacttcgccgacttaccgcccggccaggccaagtacgtcacctgcgtacgcggcgcggtgcgcgatgtgatcgtggacctgcgcaccggctcgcccacctaccgcgcctgggaggccgtcgaactcgacgaccgcgaccggcgggcggtcttcctctccgagggcctcggccacgccttccaggcgatcaccgacgacgccaccgtcgtctacctgaccacctcgggctacgcccccggccgtgagcacggcgtccacccgctcgacccggagctgggcatcacctggcttcccggcatggaaccgctgctgtccccgaaggacgctgtcgcccccaccctcgcggtggccgaggcccagggtctgctgcccgcgtacgaggactgcgtacggtacgtgtcctcgctcgccacaccactcagcgaggagaccccgtgaaggcactcgtcctggcggggggatccggcacccgcctgcgccccctgacccacacctcggcgaagcaactcgtgcccggtggccaacaaacccatcctcttctacgtcctggaagggatcgccgacgcgggcgtcaccgatgtcggcatcatcgtcggcgacacggccgacgagatcagggcggccgtcggcgacggctcccgcttcggcatcagcgtcacctacatcccgcagcaccagccgctcggcctggcccacgccgtgcgcatcgcacgggactggctcggcgaggacgacttcgtgatgtacctgggcgacaacttcctgctcggcgggatcagcgagcagctggaggagttccgcacccggcggcccgccgcgcagatcatgctcacccgggtccccgatccctccgccttcggcgtcgtcaccctcgacgaggcgggccgggtcaccggcctggaggagaagccgaagttccccaagagcgatctcgcgctggtcggcgtgtacttcttcaccgccgccgtgcacgacgccgtggacgccatccagccctccgcccgcggcgagctggagatcaccgaggccctccagtggctcctcgacaagggcctcggcatcgcgtcctccacggtcaacggctactggaaggacaccggcaacgccaccgacatgctggaggtcaaccgcacggtgctcgacaggctgaccccgtactgcgacggctccgtcgacggcgagagcgaactggtcggccgggtcgtcgtcgaggacggcgcggtgatcacccgctcccggatcgtgggccccgccatcatcggccgcggcacccgcgtcgagggctcctacatcggcccgttcacctccgtcggggcggactgcgtggtcgtcgacagcgagatcgagtactccatcgtgctggccggcgcggccatcgacggcgtcggccggatcgaggcgtccatgatcggccgtcaggcgcaggtcacccccgcgccccgcacgccccaggcccaccgtctgatcctcggcgaccacagcaaggtgcagatccgttcatgaacatcctgatcacgggagcggccggcttcatcggctcccacctcgtacgcacgatcctgggcccggacaaaccgctcggcgacgacgtccgcgtcaccgtcctggacgcgctgacctacgcgggcaaccgcgcctccctcgccgccgtcgaggacgaaccgggcttcaccttcgtgcacggcgacatcaccgacgcgctgctggtggaccgcctggtggcggcccacgacgccgtggtgcacctggccgccgagtcgcacgtcgaccgttcgatctggcgggccgacgcgttcgtacgcaccaatgtgctcggcacccacaccctgctggaggccgcgctgcggcacggcaccggcccgttcgtgcacgtgtcgaccgacgaggtgtacggctcggtcccggtcggctcgtccgtcgagagcgacccgctgacgcccagctcgccctactccgcgtccaaggcgtccagtgatctgctggccctggcctaccaccacacccacggactcgacgtgcgggtgacgcgctgctccaacaactacgggccctaccagcacccggagaaggtgatcccgctcttcgtcacccggctgctcagtggcgccgccgtcccgctctacggcgacggcgggaacgtacgcgactggctgcacgtcgacgaccactgccgcgctctgctggccgtcctcaccgacgggcgcgcggggcacacgtacaacatcggcggcggcaccgagctcaccaacaaggagctgaccggcctgctgctggacgcctgcggcgccggatgggaccgggtcgagcacgtcaccgaccgcaagggccacgaccgccggtactccgtcgactggacgaagatccgcaccgagctgggctacacccccgcgcacgacttcgccgagggcctcgccgagaccgtcgcctggtacagaaccaaccgcccgttctgggcagcgcccggggcggagcttcagggcgcatgacgcatgagggcacccggcactccacgagggagaccacccccgacgacgtcagcctgatccagatccggcagccggcgatcccgagcagctaccgcatgatctgtttccccagttcgcggaactcctcgatctgctatctggccatgtcggaactgctgctgcccaccgtggaactgctcatcgtccagtacccggccctgacctccgaggaggagcattcggccgaggaggacgcggcgctcgccgacaagatcttcgaagcggtccggggctgggccgaccgcccgctcgccctcttcgggcaccgcctcggtgccgaactcgcctacgcggtcgcccagcggctggaacgggagaccgacgcggcacccctgaccctgttcgtctccggacgcacgggaccgggccaccgcggcagcctcggcccgcccgcgctcaactgccgggtcgtcgccctggccgggtaccacgacccccgcgcacccctggccggggtacgggcctggcggcgctgcacggcgggacggttcgacctggaggtctttcccggcacccgcggctacctcgactcgcaccgccgcgaggtcgtcaacctcgtgcacgaccagctgatttcgctccgcggaccggagcccgactgagcacggccgggctccggtctcccatctcttgtgaagctcgcgaatcccgcgacccaccccagaggaaggacagtgtgcgaccgatgaccgcgaagatctttgcagtcgactcggtacgacccatagacgagttcgagcaggacgccctccgcgtcgccgatgtgatccgcgaacgcggagtctgtctcggcgaccgggtcatgctgaaggccggcaactcggcgagctacgtctgtgtgctgtacgcgctgatgcacatcggcgcctcgatcgtcctcgtcgaccagcaggaacacaaggaggagacccgccgcatcgcgctgcgcaccggcgtcaaggtcaccttcgtcgacgacgagaccccgatcgaccaggacgccgaccccatccacctgtacgaactcatggtggccacccagaaccgtccgcccatggacagcgccctgtcgttcgacgcctggggcgagctgtccgacggcctcatcatgtggacctcgggctccaccggatcgcccaagggcgtggtgaagtccggcgggaagttcctggccaacctccggcgcaacgcccaccaggtcggccaccgtcccgacgacgtcctgatgccgctgctgccgttcgcccaccagtacggcctgtcgatggtcctcatcgcctggctcacccgctgctccctggtgatcgccccctaccggcgtctggaccgggcgctgcgcatggcccgcgactcgggcaccacggtcatcgacgcgaccccctccagctaccggagcatcctgggcctggtgaccaggaagcccgccctgcgcgcgcacctggcgggcacccggatgttctgtgtcggcgcggccccgctcgacgcaccgctggtggagagctacgtacaggagttcggcctgccgctgctcgacagctacggctcgaccgagctgaacaacatcgccttcgccaccctcgacaacccggtctcctgcggccgtgccatggagggcatcgggctccggatcgtcgacgaggacggccgggaggtggcggccgggcagccgggcgagatcgaggtcgacacccccgacgcactcgaagggcagatagccgaggacggttcgatcattccggcgcccaccggctggcagcgcacgggcgacctcggccacctcgacgcggacggcaacctctacgtcctgggacgcaagttcgccgtgcaccgcatgggctacacgctctatcccgagctcatcgagcgcaaggtcgccgccgagggctgccccacccggatcgtgcccctgcccgacgaactgcgcggctcccagctggtgttcttcgtcgaggacgacgagcagcgggacgccggctactggcgggagcggctgtgcggcctgctgcccgccttcgagcagcccaacaaggtggtcgtcctggagcagttcccgctcaaccgcaacggcaagccggacaagaaggagctgacgcggatggccgccgaatagacaccggccccgcacgcgcggatggcgcccccacccgaaggtgggggcgccatccgcgtgtgcggggtgtgttcctcagctgtcgtaggggaggtcgaggggagccagcgcgtcgaagaggtcgccggggccggggttgccgggcggcgtggccccgcccaggtggtccagtacgccccacaccgcgttcagcgccgtcgtgaccgcgccctccgcgaagcccgccgtccaggacacgtcgtcgccgcacaggaagaagccgcgctgggcccgcggcagcccgcgctgcatgaactgcgtgaacagcctgcgctggtagcggtactggcccggcagattggacttgaacgcgcccatgaaatgcggctcgctctcccaggtgatggtgatcggatcaccgatgacgtgggagcggatgtcgacgccgggatagatcacgccgagcttctccagcagcacgtccagccgctcgtcggcgctcagcgtcgccatcttcagcgagtcgtcgttccaggtgtacgacaggcacatcacgccggggcggtccgggccgtcgtcgaagagatacaccccgcgcggcatccggtccgtgagcgtcatgctcatcaccggacggccggtccgcggatcggtgtcgttccagaagggccggtcggccaggacgaacagtttggaggcccccatgtagtgggtgcgctccacggcggtccacagcggctgcgtcagcagcgccggatcgcacgcgacccggttcagcagggtccacacgtgcggggtgtacaccaccgaggcgaaccgctcccggtgtccgtcggcgtcggtgacgaggaagccgtcaccgtccctggcgacggcccgcacccgtggccgggccgtccctccgtgcagcgaggcgagagaggtgccggccggccagtgcgcgcagccccgcggccggtgctcccacagcccgcgcggcacctgctgggagccgccgtcgatggcgacctggttgtcgtccgcctcggtgtagaccacgcgcaggatttcgaggagcgagttggggaagtcggtgtcccagccgccggtgccgaaccccacctggccgaagatctcccggtgccggaacgacgggaacgccgaactggtcgccaggaacccgtagaaggactggtcgtcgaactccctgaccagtcggttccatatctgcttcaccgtctcgacgtcgcggcgctggatggcgtcccgcatggtggccagctcggcccgctcctgcagggccttctcccaggccgaggccacctcctggtacacatccgggagttgctccgcggaccgcgcggtgtgccgttcgccgccgaggtcgatgagggtgctcggggtgttcgccgccagcgggttggggaaggggctggtgcgcagccccagcaggtcgatgtagtggaacagcgagcgcgcggagagcgggaagcgcatcgcccccatctccgccacgaggccgggctgcccggggaagggcaccgaccgcatccggccacccagttgctccgcctcgtatacgaccgggcgcaggcccagccgcatcagttcgtacgcggcggtcattcccgccattcccccgccgaccacggccaccggcgtaccggcgcgctcgggcggaagggcgccgagtccggcgggatggcgcagccagccgtcgtaggagaacgggaagtcgggcacgagcatggtggtgggagccgggctgaatgacgtcatcgggaaaacctctcgggccgattcggcatcgcttccagggaaaccggagacattccgagctgagccggaaatcacggcgtcgagccggccccgcacggcggggcagcggagcggtcgcacgctctcgggccgataaccccacgctatttaccggctgttgacgtcacaacccctatccaccctggttacgcgctgtgcccgggaggctttaccgcgtggtcgccacgcgataggcgggcagggtgatgaccgtgacgatgatgccgcggtccgaaagccagcggcccgtgaacctgtccaccggccgcccgtcgggaccgggcagcggacgcagaatgcgggccgtgaacgtgccctgcggccggccgttcgggccgacctcgtggcggaaggtgatgtcggcgtcgtcgaagtccagctcggtgcccagcagcgggtaccaggtcttgtagaccgcttccttggcactgaagagcagacggtcccggcgcaggctggagccgtatcctcccgagcgcgcccaggccagctcgcgcggcagcgcgatcgactccagcaccccttcgggcaggggcagatcgggttcggcgtcgatgccgatcatcgccaggtccgtgtcccgcgccaggacggcggcccggtagtgggcgcaatgggtcatgctgccgaccacgccgtcgggccactggggcacattgcgcaccccgggcagtacgggagcagacggcagccccagtgcggcgagggcgcgccgcgcacacgcccggacggtggcgaactcctcgcggcgcagatccgtcgtcatggcgaccagcgccgcctcctcggggtagagcagcgccgatccgtccggcccgaaggcctcgctcgcgaccgccccttcggggagcagttcctcgatcatgcccgtgtctcctgcggttcggtcctggcgggggtctccggttccggttccggggtgtacggcaggatctgccgcagcagccccctgggatggccgcgccggcgccactcgcgcgggtagccgatcgacacctcctcgaaccggaccccgtcgtaccaggtggtcctggggatgtgcaggtgcccgtacaccacggcggccgtgctgaaccggcggtgccagtcggcggtcagcaccgtgccgcaccactgcgcgaactccgggtgccacagcacgtccgtgggctcgcgcaccagcgggaagtggttgaccagcaccagcggcaccgacggatcgtgcgccaccagccgccgccgggtcgcggagacacgggcccggcaccagtcgtcacggctccggtacgggtcggggtggagcaggtactcgtccgtgcacaccacacccgcctcgtgcgcccgggccagcgactcctccttggtcgaggtgcccgccacccggaacgtgtagtcgtacagcaggaacagcggagcgaccgcgaccgggccgccgggaccctcccacaccggccacgggtcctcgggcgtgaccacgcccagcccccggcacatctccaccaggtaccggtagcgctcctcgccgcgcaactgcaccgtgtcctcgcgcggggtccacagctcgtggttgcccggcgcccacacgaccttggcgaaccgcccggccagcaggcgcagcgcccactcgatgtcctcggtcagctcgccgacgtccccggccacgatcagccagtcgtcctcgtgggaggggcgcagcgactcggtgatgggccggttgtcggccatcccgatgtgcagatcgctcaccgcgagcagccggggaccggcctccgcggtgacgtggtcaggcggtgtgtgcgacatcggtatccaaactgaccggcaggtcctggcggtgcgtgatgttgatcttccggtagacccgggtcagatgctgctcgaccgtgctgacggtgatgaagagcttggccccgatctcccggttggtgtaaccgtgcgccgccagcgccgccaccttgcgctccgcgtccgtcagcgacgacaccgcggcggacggggggcgcgcggcatcggccggggcggcggggcgcggctgcgcggcgggcgccgagggcgccgggggctggctcggatgcagggagcggtacagctcccgggcgccgcagcccttggcgatccgccacgccctgcgggtgtgcaccttgccctgggacgggtcgccgagctgcttgtacgcctgcccgagatcggtcagcgcccgcgccagctcgtaccagtcgctgtcctcctggagcagcgcgaccgcctgcgcgagcagcgccggacgctcgcgcagcggacgggccgccgcgagcacccgcagcgcgtgtccgcgcacccgctgaccggcgtccccggcgagctgctccctggcgaaacgttccgcctcttcgcggctgcccagcgccagccgggcttcggcgacgccgacccgccagggcaccagcgtcgaacggtccatgccccagcgccgcatcagctcgccacaggccgtgaagtcggtcagcgccgcgtgatggcgtcccgtggccagctggtgccggccacgcgcgtagagatagtgcagcccgtggcgcgtcgtgagcatgtcctccggcaccgggcggtccagcagctccgccgccgcctcgtgatcgcccatcgccgtccgcgcctcgatgagggccgacagcggcatcccgatgcccacgccccacccgtgcggcggcagctggtccagcgcctgctccgccagccgcctggcctccaccagatgaccccggcgcaaggacatgtgcgcgcggatcgcccgcagcaccgcggtccaccccggcgccttgcggtccgccgcctccaccagcagccggtcggcccacagcgtcgccgtggccggccggtccgcgtagaagagcgtcagcaggcacgcgcgcagcccgaggtgggtctcctccgtcagccgcgtgccggccagggtccgctcggcgctctcggcgaagtcctccgcgtccgtgtccgggtccgtgtcccgcgccccgtcgccgccgcgcagcacaccgtgcagcaccctcgccgaggtcagcaggatctcctcctgcgccgacagacgctcgcccgcgccccgcgccggggccggtacgtcccccaggtgttcgagcaccgccggatacgtgctggccagggcgagccgcagggctccgagctcggtggcgagccgggcgtcgggggaccggtgcagtacgtcgacgacctggcggatcgcggcggccgcgtcgtccatccagccgttccacaacaggtcgtagaccagccgcaccgtgtcgacggggggcagcaggccgtcccgtaccgcccccagcagcggacgcagctgctgcggccacgcggacggctggacccgccagatgtacttggccagatgcgcccgcagcagcatccgctccgtctcgtcgcggcagcagctctccgccatccgcagacagcgcaccgcgaactcgacctgctgcgtgcacagcgccgcacgcgcggcctcgctcagcacccgcggcacccattcctcgtcgggggcgctcatctcatggctgagcagttgggccgcgatggtcaacggcgccgccccgtcctcgtacagcagcacggccgcccgctggcgcagccgcgtcgccgcctcgtcggtcaggctctccaccaccgcggtctgcacgccgccgtgccggaatacggacttctccaggacgcccgcctcgttgagggcggtgaccacctgctccacggtccactcctcgacctccacgagccgggcgagcagtgacgtcgatccggcgccgcccagcagggcgatgccctgggcgacccgcaggccgtcggatcccgtgcggtgcacacagatcagcgcgctctgcaggaactggtcgcccgcgtggggcgttcccgcgagggcgtcctcggtctcgttcccggtcccgttcccggcctcggccgacgcggggcccgcaccggggccggccgccaagagtcgctgtcggctgaggcggtcctcgatgagcccgtggacgagcagggggttgccgccggtcgccgcgtggacggaggcggccagcggggtggaccacgaggcaggggccgcgggcttcctcgctccggcctccgggtcccgggccgcgagcagccggccgacgccgtcgacactgagcggacccagccggacgtgcaggccccgcagttggtagagcaattcctccaggacgacgggcggcgtgccgcccacgtccgggccgcggctcaccagcagcgacaccacggcgccggaggcggacgcccggagcagcatgtgggcgaggcagtacagcgactgcgggtcggcgtactgcacgtcgtcgacgacgatcaggaccggcccgcgcgcgcagacctcggcgagctggaggtggaaggccatgaggatctcggcgggtaccggctccgactccggccgcggcgtcgagtccagcgccgcgtccggtccggccgacgggtggagcggcagccggtcggagacggcctgcgcgtcgcgcaccagctgctccaccacgccgaacggcatggactgttccgcgggcgaggtgaccgcggtgatgacgcgtggccccgccccggccgtcagctccagcacgcgatggaggagcgccgtctttcccgaagccaccggcccgtcgatcacggcgatccggccggtcccggcggcggccgcggccaccgcgccggaagcggtgccggatacgaaggaggtcagtcttccgatctgttcatctcgctccaccaacacagctgcaaaagccttccccatgcgatgtgaagtggcgcacgtcggatgccattcctgcaccatggacactctcccgttcctgcgcgcacgggaagagctgtcaacgcccaaggaacgcgagcggattcgccgcgctcaccacaggtcggacgacacccacagttcttcccgttcggcgggtccgttggaactgtacccccgtcccggccgtggattgtgcccccgccattgcaggatcacgtcatcccgcttcatgggtaactcggctgaatgaacagctggttaccgagtgccatcgatcgcggctggtcatgtacccaggcggggccgggcaggaataggaacctcagggaaacctcaaggaattccaccggatcccgcgcctagttgccgacttggccgaattgcggccctggtcatttggggcgccgacagcctcgacggccgtccgcacggcagcgacgatgcggtacagatcacgtgaagtgccgaaattggccgcggaagtatgtcagctgtgacggccgaagccgggagcgggcgatccgacccgcaagccgccattcccgcatcggcggcggactttgacgacatggcctaggggtggtcgcgcgaagactaggggtgagtgatggtggagaactcattgcgcggctcgtttgaatggcctgatgtgagcctttggggcccattggaccgtagagccgcccgcatcgccgggccagggtggggatgggcgcatgacgacgaccgtcatcgggaaagtggccgagctgtacgccgttcgtgaggaggcggtgcgtgggccgagcgaccgggcgacggaggcgcagcacgcgaagggaaagctgaccgcccgtgagcggatcggccttttgctggacgagggttcgttcagggaggtcgaacagctgcggcggcaccgggccagcggtttcggcctggaggcgaagaggccttacacggatggtgtgatcaccggttggggcaccatcgagggccgtacggtcttcgtctacgcgcacgacttccgcatcttcggcggggcgctgggcgaggcccacgccacgaagatccacaagatcatggacatggcgatcgccgcgggtgctccgctggtctcgctgaacgacggcgcgggcgcccgtatccaggagggcgtctcggcgctggccggttacggcggcatcttccagcgcaacaccaaggcgtccggggtcatcccgcagatcagtgtgatgctcggcccgtgcgcgggcggcgcggcctattcgccggcgctgacggacttcgtgttcatggtccgtgagacctcgcagatgttcatcaccggtccggacgtggtcaaggccgtcaccggcgaggagatcacgcagaacgggctcggcggcgcggacgtgcacgccgggacctcgggcgtcgcgcacttcgcgtacgacgacgaggagacctgcatcgcggaggtccgctatctgctgtcgatgctcccctccaacaaccgggagaacccgcccgccgtccaggccggggacccggccgaccggcgctgcgacgccctgctgaacctcgtaccggtggacgggaaccgtccgtacgacatgctcaaggtcatcgaggagatcgtcgacgacggcgactacgtcgagatccacgagggctggtcccgcaacatcatctgcgcgctggcccgtctggacggccaggtggtcgccatcgtcgccaaccagccgcagttcctggccggcgtgctggacatcggggcatcggagaaggccgcgcgcttcgtgcagatgtgcgacgccttcaacatcccgatcgtgacactgctcgatgtgcccggcttcctgccgggcgtcgaccaggagcacggcgggatcatccggcacggcgcgaagctgctgtacgcgtactgcaacgcgaccgtgccgcggatctccctgatcctgcgcaaggcgtacggcggcgcctacatcgtcatggactcccagtccatcggcgcggacctcacctacgcctggccgaccaacgagatcgcggtgatgggcgccgagggcgccgccaacgtcatcttccgccggcagatcgccgagtccggggaccccgaggcgatgcgcgcgcggatggtcaaggagtacaaggccgagctgatgcacccctactacgcggccgagcggggcctggtcgacgacgtcatcgaccctgccgagacccgcgaggtgctgatcgcctccctcgccatgctccgcacgaagcacgcggacctgccgccgcgcaaacacggcaaccccccgcagtgaccgccgtacccatggaaaggcattgatcgcaccatgaccgcgcaccccaacggagtgaccccgccgctgccgccgacggagaccgaccggacgctgcacttcgcgggccccgcgacgttcggccgcatcccgcggatcgaccaggtggagaagaccgacatcgccgtggtcggcgtgcctttcgacagcggcgtcacctatcggccgggcgcccgcttcggcggcaacgccatccgggaggcgtcccgcaccctgcgtccctacaacccggcgcagaacgtctaccccttccacttcagtcaggtcgcggacgccggtgacatcagcgccaaccccttcgacctgaacgacgccgtggagacgatcgaggcggccgccgacgacctgatctccagcggcgcccgtctgatgacgctgggcggcgaccacaccatcgccctgccgatgctgcgtgccgtggcgaagaagcacggtcccctcgccgtcctgcacttcgacgcccatctggacacctgggacgactacttcgggcagcagtacacccacggcatgccgttccgccgcgccgtggaggagggcatcctcgacacctccgccctctcccacgtcggcacgcgcggcccgatctacggcaagaaggatctcgacgacgacgagaagctcggcttcggcatcgtcacctcggccgatgtgatgcggcgcggagtggacgaggtggcccagcagttgcgcgagcgcgtcggcgaccgtcccctgtacatctccatcgacatcgacgtcctggacccggcgcacgccccgggcaccggcacccccgaggccggcggcctcacctcccgcgagctgctggagatcctgcgcgggctcgccgactgccacctggtctccgcggacatcgtggaggtcgctccggcctacgaccacgccgacatcacctcggtggcggcgtcccacgctgcctacgagctgatcagcatcatgtccaagcagatagccccggtccgctggggtgcgacgcagtaaccaccccgacgtcccggaagcagagaaaccggaacccggcaccgcgcggcgcggtgccgggttccgtcgtatccacccgcggcggggtacccgatcggctacaccgcccggaggtgccgattcggtgcgcctttccggcgggccgaaggtactcacaccccgcctctccgcgcgaacagaatgggaaccgagcccggaccagtgatcgctgtccgggagcaggaatggaaagggagttttttcgtgaccccgcaggaccattggtggagcgcaagccagagttacgtctcggacatcctctccgttttcgcggcggccccggaccgccccgcggtgaattggcggggcgagacggcctccggcggtgaattgattcggtcggtgaccgaggcgttccacgcactgcacgacagcggcgtgcgcgcgggcgatgtcgtggccatcctggtggcgcccaacagcccggagatgctcacggcacggtacgcggcgcacctgctcggcggcgcggtgtgctacctgcggtccaccaaccccggaaccagcgaggtggcccttccgctggaccagcagatccggatcctgcgggacaccgaggccgtgaccgtctacacggacgccgagaacgcgccgcgcgccgccgaactggccgcgggcgccagtggactgcccgtgacgtgcctgacgggtgaggcgcgcaagagggagagcgcggaagacgctccgcgcgccctgccgtgggccccggatgcactggccctcatcacgttcaccagcggcagcaccggacggccgaagggcatccggctggcgggccgggcgtggaacggcctggtccagggcatggtggcggccggcggcgaagccgagggcgtcaagctcctggtcaccaccccgttgagccacaccgtcggcagcatggcggacaccgcgctggcgctgggcggcgaggtctacctgcacgagaacttcaacgccgaacagttcgtcaacaccgtggccgacgagggcatcgcgtggaccttcatggcgacggtccatctgttccagctgctcgaccacctggaggagcgcggcctgaaggacgtcgaggaaggacgcctggccccgctgcagcggctcatctacagcggcagcgcggcggcgcccgccaggatcgcccaggccgtgaaggccttcggtctcatcatcgtgcaggcgtacggcacgggagagaccggccggctcaccaccctcttcccgcacgagcacctggacccgtggctctcgaccaccgtcgggcggcccttccccgatgtggaggtcgtcgtcggcgaccaggagtcgggcgcgccgctcgccaccggcgaggtcggcgaagtccgcgtgcgctccccgcacatgatggacggctacaccggggacccggcggccaccgcgaaggtcctgcgcgacggctggtaccacaccggcgacatcggctacaccgacgaacacggctatctgcacctgctgggccgggtcgccgacgtggtcaaggtcaacggcgtcaaggtccacccgacggtggtcgaacgggagctcctctcgctcgcgggcgtccggcacgccgcggtgtacggcgtgcgggaccaggacgccgtggagcacctgcacgccacgatcgtgtgcgacccggcggtgccggtggagaccgacgccattcgcgcgcacctcgcccagtccctctccgggctgcacgtgcccgaaaagatcagcgtcgtcgccgatctgccgctgaatgacaacggaaagcccgacaaggtgcggctgcagctgctcgactcctgatccgggcgtccacgctttccgttgtccctcccctcgcatttccgtcagttccgattctccgattctccgcatctccgcattgagaaggcaaccctcatgaacctgcacctggaatcgtattcaaccggcgtgaccgccaaggaactcgccgagcggcggcgtgaattcctggagatcggccgccgctccggacacttccccagcgccagcgcgcgccaggacggcgtggactcccagatcagcgtctggtgcagcaacgactacctcggtatggggcagaacccccaggtcatcgaggcgatgaagaagaccatcgacacccacggcgtgggctccggcggctcgcggaacatcggtggcaccaaccactaccacgtgctgctcgaagcggagctggcggacctccacggcaaggaggcggcgctcctcttcacctccggctacacggccaacgacggttccctgagcgtcctggccgggacgcccaaggacacgatcgtcttctccgacgagaagaaccacgcgtcgatcatcgacgggctgcggcacagcggcgcgcagaagcacatcttccggcacaacgacgtcgcgcacctggcggagctgctcgcggccgcccccgccgaccgtccgaagctgatcgtccttgagtcggtctattcgatgtcgggcgacatcgcgccgctggccgagatcgccgagctcgcgcgccgctacgacgccaccacgtacatcgacgaggtgcacgcggtcggcatgtacggtccgcagggcgccggcatcgccgcccgtgagggcatagccgaccagttcaccgtcgtgatgggcacgctggccaagggctacggcaccgtcggcggctacattgccggtcccgccgccctcgtcgacgccgtgcgcaccctgtcgcgcgccttcgtcttcaccacctcgctgccgccggccgtcgcggcgggtgcgctggaggccgtgcgctacctccggaactccgacgtcgagcggaaggtgctggcggagaacgcccagctgctgcaccggctgctcgatgaggccgacatcccgttcatctcgccggactcgcacatcgtctccgccttcatcggggacgacgagacctgcaagcaggcgtcccggctgctcttcgagcggcacgggatctacgtccagtccatcaacgcccccagcgtgccgctcggccaggagatcctgcggatcgcgccgtccacggtgcacgggcgcgaggacgtcgagaacttcgccgaggccctccgcgggatctggaaagagctgaacatcccgacggccaccgacaggaactggctttcgtgacccggtcggtggcggccgtcctcgcagagtccgcggggcggtggccatcccgcaccgccctggtgtgcggggcggagcggatctcgtacgcgcgtctgtgggaccgggcccgccggtacgccgccgccctgcgcggccagggcatcggccccgacgacaaggtcgcgctgctgatgccgaacaccccggagttcgcggcggtgtacttcgcggtgctcgcgctcggcgccgtcgtcgtcccggtccacaccctgctgaagcccgcggaggtctcgcatctcctccgggactcgggagcgcgggccctcgtatgggccgggacgctcccgcaggagaccgcacgggacgccggggagaccggggtcctgctcctgaccgtgggggaggccctgcacggctccgtcctcctcgacgacggcgtcgagcccatcgacacgtatgtcgagcggggggcggacgacctcgcgctggtgctgtacacctccggtacgacgggcaggccgaagggggcgatgctcacgcacggcaacgtcgcgacgaacatcgccgtgaccgccgtgtcccccttcgccttcggcgaggacgacgtgctgctcggcgcgctgccgctgtcgcacaccttcggccagatctgcgggatggccgtcaccttccacgcgggcgcgacgctggtggtcatggagcgcttcgaggcgcacgacgccctgcggctgatgcgcgagcacggctgcacggtcttcatgggcgtgccgaccatgtaccacgcgctgctcgaagcggtcgcggccggcgccccggcgccgcgcctcacccgcgtgtacagcggtgggtcggctctgccggtgccggtgctcgaccgggtgcgggcggcgttcggctgcgaggtgtacgaggggtacgggctcaccgagacctcgccctgcgtggcgtacaaccagccgggcatcccctgcaagccgggcacggtggggctgcccatcgacggcgtacgggtcgccatcgccgacgcggagctggaaggacgcatcaggctgctgaagcagggcgacatcggcgagatcgtcgtgagcggacacaacgtgatggcgggctacctcggccggccgcaggagaccgccgaggtactggtcgacggctggttccggaccggggacatgggcgtgcaggacgaggacggctatctgtccatcgtcgaccggaagaaggacatgatcgtccgcggtggctacaacgtctacccccgcgaggtggaggacgtactgctgcgccatcccgccgtggacggcgcctgcgtggtcggcgtgccgagcgtgaagcacggcgaggaggtgtgcgccgtggtccgggtgaagcccggtcagcgcgcgagcggtctcctcgcggaggagatcgtggcctggagccgggtgcacatggcggcctacaagtacccgcgccgcgtcgagttcgtggagaccttcccgctgggatcgagcggcaaggtcctcaagcgggagctggcacaccgctacgcgtgatgccgtcgcgggggtgagtcccggtgaactcgcccccgccgcggcatcggcggactgccgctgcggactgctgctgaggactgccgctaggggggcgcgcacggagatagggggtggttggcggtgacgggcccctctcccggccgattgaatgactcaacgatcggcatgagcgtggcggtcgctgcagggaagtgaggtaccgtgccgacccgcactgttgaggaagacatcgagatagtcctgatcgtccgcgacgacatgcggcgctatggcgtcgagggaatgtgccgttcgctggacacccccgtcgaggcgcagtcctacgcggatttcgatgatctcgaccccttctccggaggccagttggtcatcctctccagtgatgcggcgggtcccctctccgccgagaccgccgaaagcctgcggacgcatgagatacccgtgctgatcctggtcgactcggccgccccggtcgagcagtcctgggccgaccaggcgcgcggcttcctggactgggcggatctgcgccccgacaccttgcgcgacgcgatcgccgatgtggcggccgggcgcttcttcgcgtcggagaccttggcgcggcgctccgtgacggcggcggagcagacggagggcggaacgcccgcggcgcggagcccgatcacgctgacggcgcgtgaactccaggtcctgcgcctgatcgcgggcggtctgagcaatcggcagatcgcgcggtcgctgaacatctccgagcacggtgtcaaacgcttggtcgggatcgtcctggccaagctcaactgtccgaaccgcacgctcgccgtggtccgtgccattgacgcgggtctcctcaccttgtgaattgcgcccgacccgatccgatcggggttcgcatggctcccatgcaacccgacgccggtgacatcgcgccaatgccgttcccggcctgtggataaagttatccacaggggtttcgtgatccgagggcccacgggaccgtcgagccatgacgaagaaccaggaaccacgcgacccgtccggtacccggccccgtaaggcggcggcgtccggcaagccctccctccaccacgcggtgccccccacggggccgggcggcccgccggcggccgccgactcacagatcaccctgcgcagcccggccgaactggccgacgccctgccctacatgctcggcttccacccgaccgactccctcgtcatggtcgccctgcacggcgagggaggccgcttcggcggccggctgcgggtcggcattcccaccgaccggggggagtgggaggacaccgcccggcaggtcgccgactgcctggtgcacggcagcgaacggcgcggcggcaagcccgacggcatcgtcgtcttcctctgccaggacccgcgcggcggggagagcgggcagcgggtgatgacccggctgcgcccgctcgcccagcgcatcaggctcgcctgcggagcgctggacgtgcccgtgctggaggcgctgtgcctctccggcggccggtactggtcctactgctgccccgacgcgcggtgctgcccggccgaagggaccgccctgaccgtgcccggaacctcggtgatggcggccgccgccacctacgccggactccgggtcaggggttcgctccaggagatcgagggccgcctggcgcccctgcgcggaccgctcgccgatgaacaggagcggtccctggacctggccgccaccgcgctcgtaccgaagatcctcgacggagccacccgggaggacgtgggcgcggacaccctggaactcgcccggaccctgatgcggcgcctcaccctcgccccgcccgccgacggcgggccctgcgccgaggactgggacgacgcgctcctcggacacgacgaggcggcctccctcatcctcggcctccaggaccgcgagatcagggacatcgccgcggagtggatggagggcgaggaagccgccccggcgctgcgtctgtggcgcgccctcgcccggcgctgcgtcggcgcctacggagagcacgcggccgccccgctgaccctggcgggctgggtgtcctggtccaccggtgacgaaccgaccgcccgcatcgccctgggaatggccctgcgggccgacgccgactaccgcttcgcccaactcctccaccacgcctgcaacgaaggcatcgacccggagggactgcgggagtgcctgcgcgcggagcggggacggcgggagccgcgccgcgcccgggcggccgccgtcacccggccgccggggcggcgtccccggaccacccgccccgcaccccgtgaccggcgccgcacggcggggagcgagcagtga

SEQ ID NO: 19 - protein, 367 aa, Streptomyces aizunensis
VTYPAIGHVFPIVPLAWALRSAGHEVLVASAGDALEAANAGLHVADVAPGFHLEDFLQSTAGELMARLRGPGGVDPMDGLTLFAHLNNHLADGIVRTADDFRPDLIVFEQIFVSGLIAAARLGVPAVQHNFGFARGTQLRELTVSMLTETMARHGVDRVSERVPVIDIAPPSMAEPERDGWSMRPVPYNSGAVLPDWLLEKPGRRRVGVTLGTASVHINGLGPVQRLAAAAAGVDAEFVLALGDVDTTALGELPPNVRAVGWVPLTALLQTCDAAVHHGGAGTTLAALNAGVPQLVLPDGADRHINAEAVRDRGAGLLGTADDLSAEVLVQLLSDEKMTAAAREVRAEIRTMPSPVSLVPRLEELAG

SEQ ID NO: 20 - DNA, 1104 bp, Streptomyces aizunensis
gtgacgtatccggccatcggccacgtttttcccattgttccgctggcctgggcgttgcgctcggccggccacgaggtgctggtcgccagcgcgggtgacgcgctggaggccgccaacgccggtctgcacgtggcggatgtcgcccccggcttccacctggaggacttcctccagtcgacggccggtgagctgatggcccgcctgcgcggtccgggcggcgtcgacccgatggacgggctgaccctcttcgcccacctcaacaaccacctggcggacggcatcgtgcggaccgccgacgatttccggcccgatctgatcgtcttcgagcagatcttcgtgtccggtctgatcgcggcggcgcggctgggtgtgccggccgtgcagcacaacttcggtttcgcgcggggtacgcagctgcgcgagctgacggtgtcgatgctcaccgagacgatggcgcggcacggcgtggaccgggtgtccgaacgggtcccggtgatcgacatcgcgccgccgagcatggcggagcccgagcgggacggctggtcgatgcggccggtcccgtacaacagcggtgcggtgctgccggactggctgctggagaagccggggcgccgccgggtcggggtgacgctcggcacggcctcggtccacatcaacggcctgggcccggtgcagcggctcgcggcggcggctgccggggtggacgccgagttcgtgctggcgctgggcgatgtggacaccacggcgctcggtgaactgcctcccaacgtccgggccgtggggtgggtgccgctgacggcgctgctgcagacctgcgacgcggccgtgcaccacggtggtgcggggacgacgctggcggcgctgaacgccggtgtgccgcagctcgtcctgccggacggagcggaccgtcacatcaatgcggaggccgtacgggaccggggtgccggtctgctcggcaccgccgacgacctctccgcggaggtcctcgtacagctgctttcggacgagaagatgacggcggccgcgcgcgaggtgcgcgcggagatccggacgatgccctctccggtgtcgctggtgccgaggctggaggagctggcgggctga

SEQ ID NO: 21 - protein, 8147 aa, Streptomyces aizunensis
MLNESEEFTPEINVASEVGGTQGESPESTPSWQQRLTGLTEAEQHTALLEWVSSLASAALRDAAPDTLDPHRPFLDLGFDSLAAVDLHARLVAGTGLRLPVTLAFDHPTPAHLARHLHAAILGLTGPAETPVTAAVGSDEPIAIVGIGCHFPGGVQSPEALWNLVETGTDAISAFPTGRGWDLDALYDPDPDRAGTSYAREGGFLHDADAFDAAFFGISPREALAMDPQQRLLLEASWEAFDRAGVDPAALRGGQVGVFVGAETQEYGPRLQDATDGFEGYLVTGNAASVASGRIAYTFGFEGPTVTVDTACSSSLAALHLAVQALRTGECSLALAGGVAVMASPGSFVSFSRQRGLAPDGRCKPFAAAADGTAWGEGVGMLLVERLSDARAKGHRILAVVRGSAINQDGASNGLTAPSGPSQQRVIRQALANAGLSAAEVDVVEAHGTGTRLGDPIEAQALLATYGQEHTDDRPLWLGSLKSNIGHTQAAAGVAGIIKMIMAMRHGVLPRTLHVDAPTPHVDWEAGAVTLLTEAVEWPESDRPRRAGVSSFGMSGTNAHVIVEEPAAQDREGAPTSGAQAPDSSQGQAQGTSTAPVLLPWALSAKTPEALRAQARRLGTLIAAQPHVTPLDIGHSLATTRGRFEQRAIVLGDDREAFLDALHALAEGNDTPSVVQGAAAPGKLAFLFTGQGSQRLGMGRELYETHPVFADALDDACWYLDDQLELPLLDVLFADEGSPEAALLHQTAYTQPALFAVEVALFRLVDSWGLKPDFVAGHSIGEIAAAHVAGVFSLEDACMLVAARGRLMQALPAGGVMIALQASEDEVLPLLTDRVSIAAINGPQAVVIAGDEDAAAAIAETFQAAGRKTKRLTVSHAFHSPHMDAMLEEFLRVAQVLDYAKPTLPVVSLLTGTTATPAELATPAYWVRHVRDAVRYLDGVRTLHQRGVRTFLELGPDAVLTAMAQDCVDPQGAAFAPALRSGRPEAATVLNAVAHAHVRGAETDWAAFFAGTGAQRVDLPTYAFQRQRYWMDSRTPAPDSAAQRAHGGADPVDRVFWDAVEHEDVATLAAALELDLDGEQPLSEVVPALSAWRRRRRTQSEVDGWRYRVTWKPLTEVSTSGLSGSWVVISPAGGADDSAVVSALVGRGVDVRRVVVEAGVDRSALAGLLAEVGSPSGVVSLLGLDESGGLLGTVGLVQALGDAGVGAPLWCLTRGAVSVGRSDRLVSPVQAQVWGLGRVAALEVPEWWGGLIDLPEVLDERAVSRLVGVLAGSGEDQVAVRSSGVFGRRLVRAPRAEGASAWSPTGTVLVTGGTGVLGGRVARWLAGAGAERLVLTSRRGLDAPGAVELVEELTTGFGVEVSVVACDAADRDALRALLSAEAGSLTAVVHTAGVLDDGVLDALTPDRIDSVVRAKAVSALNLHELTAELGIELSDFVLFSSVTGTVGAAGQANYAAANAFLDALAEQRRADGLAATSIAWGPWAEGGMAADEAMDARMRREGMPPMAPTSAMSALEQAVGAGETALTVADIDWERFSSVIAAVRPNPLIGDFVVGAEGTAAASGHGSVVTGADVAATVSGRLAGLTQAEQERELLSLVRLHVAAVLGHDGSDAVGAERAFKELGFDSLTSVELRNRLGAATDLRLPTTLVYDYPTSAALAEYLRGELAGSAQDAGPPLPAVVGSAADDDPIVIVSMSCRFPGGVRTPEDLWQLLADGTDTVAAFPADRGWDLDGLYSADPERSGTSYTREGGFLYDAADFDADFFGISPREALAMDPQQRLLLETAWETFERAGIDPASLRGSQAGVFVGTNGQDYLSLVTREGDGLDGLEGHVGTGNAASVVSGRLSYVFGLEGPAITVDTACSSSLVALHLAVQALRQGECTLALAGGVTVMSTPDAFVDFSRQRGLAEDGRIKAFASAADGTGWGEGVGMLLVERLSDARRNGHPVLAVVRGSAINQDGASNGLTAPNGPSQQRVIRQALAGAGLSAADVDAVEAHGTGTRLGDPIEAQALLATYGQGRPADRPLWLGSVKSNIGHTQAAAGVAGVMKMVMAMRHGVLPRTLHVDGPTPHVDWSAGDVALLTEQREWPATGHPRRAGVSSFGLSGTNAHTIIEEAPADDDAEPTTGAGTAPSVLPLLISAKSDAGLRAQSEQLATHLVGNPDVPIGDIAYSLTTGRSGLETRAILVGDADNRTGLAAALRSLAAGEQAPGLVQGTVTEGGLAFLFTGQGSQRLGMGRELYETYPVFADALDAVCARMDLEVPLRDVLFGAYAGLLDETAYTQPALFAVEVALFRLVESWGLRPDFVAGHSIGEIAAAHVAGVLSLDDACALVEARGRLMGALPGGGVMIAVQAPEAEVLPLLTERVSIAAINGPQSVVIAGDEADAVAIVESFTGRKSKRLTVSHAFHSPHMDGMLEDFRAVAEGLSYEAPRIPVVSNLTGALVSDEMGSAEFWVRHVREAVRFLDGMRVLEAAGVTTYVELGPGGVLSALAQECVSGDGAAFVPVLRSGRPEAETAVTALAQAHVRGVDVDWAAFFSGTGVQRVDLPTYAFQRQRFWPAMTAESAPVGGTVDAVDAHFWDVIEQEDVESLAELLGLDDASAWGSVVPALSAWRRQGQQQAQVDGWRYRASWKPVTAAVSSGVVSGTWVVAVPAGSAGDDARVEAVTNGLAGRGVDVRRVVVEAGVDRAALAGLLAGEGSLAGVVSLLGLDESGGLAATAGLVQALGDAGVSAPLWCLTRGAVSVGRSDRLVSPVQAQVWGLGRVAALEVPERWGGLVDLPEVLDERAVSRLIGVLAGSGEDQVAVRSSGVFGRRLVRAPRAEGAASWTPTGTVLVTGGTGVLGGRVARWLAGAGAERLVLTSRRGLDAPGTAELVEELTSSGVEVSVVACDAADRDALRALLSSEAGSLTAVIHTAGVLDDGVLDALTPDRIDGVVRAKAVSALNLHELTAELGIELSAFVLFSSMSGTVGTAGQANYAAANAYLDALAEQRRADGLAATSIAWGPWAEGGMAADAALEARMRRDGVPPMPADPAIRALRQAVAGDDAVLTVADVEWDRFLPGFVAARHSELFSELRDVRDARAAQDRAQAAVAADRPDSLSGRLSAQAPAEQERELLDLVRTQVAAVLGHAGVENVGAGRAFKELGFDSLMAVELRNRIGSATELRLPATLIYDHPTSAALAEFLRGELVGTVRVADKVLPAVVSADEDPIAIVSMSCRFPGGVRTPEDLWRLLVDGTDAVGAFPADRGWDLDRLYSPDPDQPGTSYTREGGFFDGAADFDPGFFGISPREALAMDPQQRLLLETSWEAIERAGIDPSSLRGSQAGVFVGTNGQDYLSLITRESEGLEGHLGTGNAGSVMSGRVSYVLGLEGPAVTVDTACSSSLVALHWAIQALRQGECSMALAGGVTVMSTPENFVDFSRQRGLAEDGRIKAFASAADGTGWGEGVGMLLVERLSDARRNGHPVLAVVRGSAVNQDGASNGLTAPNGPSQQRVIRAALASAGLSAADVDVVEAHGTGTKLGDPIEAQALLATYGQDRPAGRPLWLGSIKSNIGHTQAAAGVAGIIKMVLAMQHGVLPQTLHVDEPTPHVDWSAGEVTLLTEQTAWPTVDRPRRAGVSSFGISGTNAHTIIEQAPAVEQLADGDATPATPALALPLPYVLSAKSPEALRAQASVLRTHLEATDHNGPGSDDLAFSLATARAHLEHRAVLTADDPQEFREALARLADGDPSPRITTGAVSDGRTAFLFTGQGSQRLGMGRELYEAYPVFADALDAVCAHVDAHLEVPLKDVLFGADAGLLDQTAYTQPALFAVEVALFRLVESWGVKPDFVAGHSIGEIAAAHVAGVFSLQDASELVFARGRLMQALPTGGVMIAVQASEDEVLPLLTDRVSIAAINGPQSVVIAGDEADAVAIAESFTDRKSKRLTVSHAFHSPHMDGMLDAFREIAEGLSYEPSRIPVVSNLTGALVSDEMGSAEFWVRHVREAVRFLDGIRTLEAAGVTKYVELGPDGVLSAMAQDCVSGEGSVFIPVLRKARPEAESVTTALASAHVHGIPVDWQAYFAGTGAQRVDLPTYAFQRQRYWPSAAAFVTGDPTAIGLGDAGHPLLGAAVALADSEGVLFTGRLSLDTHPWLADHTILGSVLLPGTAFVDLAIRAGDQVGCDVVEELTLEAPLVVPQRGGVQLQLVVEAPSGPGQRPFSVHSRRQDAYAEEPWMRHASGVLTSGVSRRELSVEGGEFEALAVWPPTGAVPVDVRGLYEELAEAGVAYGPLFQGLKAAWRRDGELFTEVALPGEARREAARFGLHPALLDAGLHAIGHGEGPEPAMTGALLPFSWAGVSLYAAGASSLRMRLTPHTPDDAHTMALLVADETGRPVAAVESLILRTASADQVRAADGGHLDSLFKVEWLPVAGGATPHGDSTGRRWAVLGRDGLGLPATGVQGQVAEYDDASALGAALAAGEPVPDAVFVHPGALPGQDTDTTAASVHAAVTDALSFVQEWLADERFAATRLVWLTSGAVADEPGAGVRDLAGSAVRGLLRSAQSENPGQLLMLDLDQDPASLAALPAALAAGEPELAIRRGELRTPRLTRVPSADAAAEPLGTLGDPSGTVLVTGATGTLGGLFARHLVTAYGVRRLLLTSRRGPEAEGAAELVAELEQLGAHVELVACDAADRSALAALLGAVPSEHPLTAVVHTAGVLDDGILSSLTPERVAAVLRPKVDAAWNLHELTRELGLSAFVLFSGAAAAFGAAGQGNYAAANSFLEALAEQRRAEGLPATSLAWGLWAPQTGGMAQQLDEVDLRRIARDGVGGLSGDEGLGLFDTAMTVDAAVLLPMRLDLAVARAQAVSTGETPALLRALIRVPARRAVEQRTAADGASPLAARLSALPDAEREDMLLDLVCGRVAEVLGHTDARAVDADRAFKELGFDSLTAVELRNVLKAATGLRLSPTLVFDYPTPVALARHLLAELAGTADDQDAVRGRKAPARPATAAVTSVTGEDPIVIVGMGCRFPGGVRSPEDLWQLVATGGDGITGFPSDRGWNVEALYHPDPDHAGTSYTREGGFLHDAADFDPGFFGISPREALAMDPQQRLLLETSWEAFERAGIDPATLRGSRTGVFAGVMYHDYVTGIGDGGSAVELPEGVEGYLGTGNAGSIASGRIAYTFGLEGPAVTVDTACSSSLVALHWAIQALRSGECTMALAGGVAVMATPETFVDFSRQRGLSADGRCKSFAAAADGTGWAEGAGMLLVERLSDAERNGHPVLAVVRGSAINQDGASNGLTAPNGPSQQRVIREALASADLSAADIDAVEAHGTGTRLGDPIEAQALLATYGREREAGRPLWLGSIKSNIGHTQAAAGVAGIIKMVMAMRHGVLPQTLHVDEPSPQVDWEAGEVSLLTGAMPWPQTGRPRRAGVSSFGISGTNAHTIIEQPPTREVTPTVPVAPVVPTVPTVPVVPWVLSGKGEEALRAQARQLQSYVLRAPELRPVDIAGSLAVGRASFEDRAAVVAADREGLLAALAALADGGSATGAVEGSAVGGKLAFLFTGQGSQRLGMGRELYEAYPVFAEALDAVCARLELPLKDVLFGADAGLLDETAYTQPALFAVEVALFRLVESWGLRPDFVAGHSIGEIAAAHVAGVFSLDDACALVEARGRLMGALPAGGVMIAVQASEDEVLPLLTDRVSIAAINGPRSVVIAGDEADAVAIVESFTGRKSKRLTVSHAFHSPHMDGMLEDFRAVAEGLSYEAPRIPVVSNLTGTLVTDEMGSAEFWVRHVREAVRFLDGIRALEAAGVTTYVELGPGGVLSALAQECVSGDGAAFVPVLRSGRSEAETAVTALAQAHVRGVNVDWAAFFAGTGAERVDLPTYAFQRQRYWLHIPRVAQSGVADEVDARFWDAVEREDLESLASTLEVDDESAWSSVLPALSAWRRERRAQSEVDGWRYRVSWKPLAEVSASGLSGSWVVISPAGSVDDSAVVSALVGRGAEVRRVVVEAGVDRSALAGLLADAGSAAGVVSLLGLDESEGLLGTVGLVQALGDAGVEAPLWCLTRGAVSVGRSDRLVSPVQAQVWGLGRVAALEVPERWGGLVDLPEVLDERAVARLVGVLAGSGEDQVAVRSSGVFGRRLVRAPRAEGASAWTPTGTVLVTGGTGVLGGRVARWLAGAGAERLVLTSRRGPDAPGAAELVEELTTGFGVEVSVVACDAADRDALRTLLSAEAGTLTAVIHTAGVLDDGVLDALTPDRIDSVLRAKAVSAFNLHELTAELGIELSAFVLFSSMSGTVGAAGQANYAAANAYLDALAEQRRADGLAATSLAWGPWAEGGMAGDDAMDARMRREGLPPMAPDAALTLLRQSVGSADAALMVVDVEWQRFAPALTVVRPSNLLAELPEARPAGTDSRTGGATSSEGAGSFAERLAALGGAEQDKELLNLVRTHIAAVLGHGGSEAVGAERAFKELGFDSLTAVELRNRLGAATGVRLPATLIFDYPTATALAAYLRGELLGTQVVVSGPVSNGVVVDDDPIAIVAMSCRFPGGVRTPEDLWRLLSTGGDAIGEFPADRGWDLSRLYSPDPDKQGTFYARAGGFLYDAADFDADFFGISPREALAMDPQQRLLLETSWEAFERAGIDPSSLRGSQAGVFVGTNGQDYGAMLQTIPDGIEGFLGTGNAASVVSGRLSYAFGLEGPAVTVDTACSASLVALHWAVQALRSGECSLALAGGVTVMSSPGAYIDFSRQRGLAEDGRIKAFAAAADGTGWGEGVGMLLVERLSDARRNGHPVLALVRGSAINQDGASNGLTAPNGPSQQRVIRQALANAGLSAAEVDAVEAHGTGTRLGDPIEVQALLATYGREREADQPLWLGSIKSNIGHTQAAAGVAGVIKMVLAMEHGVLPQTLHVDEPTPHVDWSAGDVALLTDAVEWPETGRPRRAGVSSFGFSGTNAHTVLEQAPKPEEPEESQQPEETNAPARPHQSGVMPWTLSAKSEAALRVQAERLRTRIASDPLLQPVDVAYSLATSRAALERRAVVVATERDEFLAGLKALASGQPAPGLVQGRVTEGGLAFLFTGQGSQRLGMGRELYETYPVFADALDAVCVRLELPLMDVLFGTERDALDETGYTQPALFAVEVALFRLVESWGVRPDFLAGHSIGEIAAAHVAGVFSLDDACALVEARGRLMQALPTGGVMIAVQASEAEVLPLLTERVSIAAINGPQSVVIAGDEADAVALVESFTGRKSKRLTVSHAFHSPHMDGMLADFRKVAEGLSYEAPRIPVVSNLTGALVTDEMGSADFWVRHVREAVRFLDGTRTLEALGVTTYVELGPDGVLSAMAQECVTGEDSVFVPVLRSGRPEAESVTTALAQVHVRGIAVDWQAYFAGTGAQRVDLPTYAFQRRRYWLEEAPATAAVEPLTGSLGAVDAQFWAAVDNADLSALTATLDIDVDADQPLSALLPALSAWRRQRQEQSVVDGWRYTVTWKPMADPAVARPTGTWLVVTPATSLVDLPAVSAALAAQGVDVREVALEAAELDRDGVAGRMREALAGDRADGVLSLLALAEHPHPAHPAAPTGLLLTGTLVQALGDAGVDAPLWCLTTGAVATAPSDLIGSAAQAQVWGLGRVVALEHPERWGGLVDLPVPADERALDRLLAVLAGAGDEDQIAVRSAGLLARRIGHAAPPAAGQHADSGTSGAGAAAGSAWRPRGTVLVTGGTGALGGHVARWLAAHGAEHLVLLSRRGPQAPGADALVAEIAALGAGATAVACDVTDRTAVSELLAGLADGTYGPGLTAVFHTAGAGQFAPLDGTGPGEVAEVVAAKVAGAAHLDELLGDTELDAFVLFSSIAGVWGSGGQSAYAAANAHLDALAQQRRARGLTATSVAWGPWGEGGLVADDEAAEQLRRRGLPVMAPELSIAALQQALDGDETAVTVADVDWDLFVPAFTAARPRPLITDLPEVRRALAAEQDGAATAAGEAAGLEAELRGMSGTEAEGVVLNLVRTQVAVVLGHGGATAVEAARAFKELGFDSLTAVELRNRLSTATGLRLPASLVFDYPTPAALAAHIRAELLGEDTTPELPALAEIDKLEFLLSSVPEDTTERARVTARLESLLSNWNRAERAVIGEDEEISIESASADDLFDIINNEFGKS

SEQ ID NO: 22 - DNA, 24444 bp, Streptomyces aizunensis
atgttgaatgagtccgaggaattcacgcccgaaatcaatgtcgcctccgaagtcggtggaacgcagggcgaaagtcctgaaagcacgccgtcgtggcagcagcgcctgaccggcctcaccgaggccgagcagcacaccgcactgctggagtgggtgtcctcgctggcatccgccgcactgcgcgacgcggcccccgacacgctcgacccccaccgccccttcctggatctgggcttcgactcgctcgccgccgtcgacctgcacgccaggctcgtcgcgggaaccgggctgcggctgccggtcaccctggccttcgaccaccccacccccgcgcacctcgcccgtcatctgcacgcggcgatcctcggactgaccggccccgccgagacgcccgtcaccgcggcggtcggcagcgacgaacccatcgccatcgtcggcatcggctgccatttcccgggcggcgtacagtcccccgaggcgctgtggaacctcgtcgagaccggcaccgacgccatttccgcattccccaccgggcgcggctgggatctcgacgcgctgtatgacccggatcccgaccgggcgggcaccagttatgcccgcgagggcggattcctgcacgacgccgacgcattcgacgcggcattcttcgggatatccccgcgcgaagccctcgccatggatccgcagcagcgactccttctcgaagcgtcctgggaggcattcgaccgcgccggggtagaccccgccgcattgcgcggcggtcaggtcggcgtattcgtcggcgccgagacccaggaatacggcccccggctccaggacgccaccgacggattcgagggctacctcgtcaccggaaacgcggccagcgtcgcctccggccgtatcgcctacaccttcggcttcgagggcccgacggtcaccgtcgacacggcctgctcctcctcactcgccgccctccacctcgccgtccaggcgctgcgcaccggcgaatgctccctcgcgctcgccggtggcgtcgcggtcatggcgagccccggctcgttcgtctcgttcagccgccagcgcggcctggcccccgacggccgctgcaagccgttcgcggccgccgccgacggcacggcgtggggcgagggcgtcggcatgctgctggtcgaacggctctccgacgcgcgcgccaagggccaccggatcctcgcggtcgtccgcggctccgccatcaaccaggacggcgccagcaacggcctcaccgcccccagcggtccgtcccagcagcgcgtcatccgccaggccctcgccaacgccggcctgtccgccgccgaggtcgacgtcgtcgaggcgcacggcaccggcacccggctcggcgacccgatcgaggcccaggcgctcctcgccacgtacggccaggagcacaccgatgaccggccgctgtggctcggctccctgaagtcgaacatcggccacacgcaggccgccgccggagtcgccggcatcatcaagatgatcatggcgatgcggcacggggtactgccccggaccctgcacgtcgacgcgccgaccccgcacgtcgactgggaggccggagcggtcaccttgctgaccgaagccgtggagtggccggagtcggaccgcccgcgccgtgcgggcgtgtcctccttcggcatgagcggcaccaacgcccacgtcatcgtcgaagagccggccgcccaggaccgcgagggcgcccccacctccggcgcccaagcccccgactccagccagggccaggcacagggcacctccaccgcgccggttctcctcccgtgggcgctctccgccaagacccccgaggccctccgcgcccaggcacgccgactcggcaccctgatcgcggcgcagccgcacgtcacccccctcgacatcggccactccctcgcgaccacccggggccgcttcgagcagcgcgccatcgtgctcggcgacgaccgcgaggcgttcctcgacgccctgcacgccctcgccgagggcaacgacacgccctccgtggtccagggcgccgccgcaccgggcaagctcgccttcctcttcaccggccagggcagccagcgcctcggcatgggccgcgaactgtacgagacccacccggtgttcgccgacgccctcgacgacgcctgctggtacctggacgaccaactcgaactcccgctcctcgacgtgctgttcgccgacgagggcagccccgaggccgcacttctgcaccagaccgcctacacgcagcccgcgctgttcgcggtcgaggtggcgctgttccgcctggtcgacagctggggcctgaagcccgacttcgtcgcgggccactccatcggcgagatcgcggccgcacacgtggccggagtgttctccctggaggacgcctgcatgctcgtcgccgcacgcggccgcctcatgcaggcgctgccggccggtggcgtgatgatcgcgctgcaagcgtccgaggacgaggtgctgccgctgctcaccgaccgggtgagcatcgccgcgatcaacggcccgcaggccgtggtcatcgccggtgacgaagacgcggcggccgcgatcgccgagaccttccaggccgcgggccgcaagaccaagcggctgacggtcagccacgcgttccactcgccccacatggacgccatgctggaggaattcctccgcgtcgcccaggtgctggactacgccaagcccaccctccccgtcgtctccctcctcaccggcaccaccgcgacccccgccgaactggccacccccgcatactgggtgcgccacgtccgggacgccgtccgttacctcgacggcgtacgcaccctccaccagcggggcgtacgcaccttcctggaactcgggccggacgcggtgctcaccgccatggcacaggactgcgtcgacccgcagggcgccgccttcgcccccgcgctgcgctccggccgcccggaggcggccactgtgctcaacgccgtcgcgcacgcccacgtccggggtgcggagacggactgggccgcgttcttcgccggtacgggcgctcagcgggtcgatctgccgacgtacgccttccagcggcagcgctactggatggactcccgcaccccggccccggactccgccgcgcagcgggcgcacggcggcgccgatccggtcgaccgtgtgttctgggacgccgtcgagcacgaggacgtggccacgctcgccgccgccctcgaactcgacctcgacggcgaacagccgctcagcgaggtcgttccggcactgtccgcctggcgtcgccgccgccgcacccagtcggaggtggacggctggcgttaccgggtgacgtggaagccgctgactgaggtctcgacgtctgggttgtccggttcctgggtggtgatctcgccagctgggggtgccgatgactcggctgtggtgagtgcgctggttgggcgtggtgttgacgtccgtcgggttgtggtcgaggcgggtgtggaccgttcggcgctggctgggttgctggctgaggttggttcgccttcgggtgtggtgtcgcttctcgggctggatgagtccggggggttgttggggactgttggtttggtgcaggcgttgggtgatgccggggtgggggcgccgttgtggtgcctgactcgtggtgcggtgtctgtggggcgttcggatcggcttgtgtcgccggttcaggcgcaggtgtggggtttggggcgggttgctgctctggaggttccggagtggtggggcgggctcatcgatctgcctgaggtgctggacgagcgggctgtgtcccgcttggtcggtgtacttgcgggttccggtgaggatcaggtcgcggttcgttcgtctggtgtgttcggtcgtcgtctggtgcgtgcaccgcgggccgagggtgcttcggcgtggtctccgaccggcacggttctcgtcaccggtggtacgggtgtgctgggtggccgggtggcgcgttggctggcgggggcgggtgctgagcgtctggtgctgaccagccgtcgtgggctggatgcgccgggtgcggttgagctggtggaagagctgaccaccggctttggggtggaggtttcggtcgtcgcgtgtgatgcggccgaccgtgacgccctgcgtgccctgctgtccgctgaggccgggtctctgaccgctgtggtgcacacggccggtgttctggacgacggcgtcctggatgctctgaccccggaccgtatcgacagcgtcgtgcgtgcgaaagccgtctcggctctcaacctgcatgagctgacggccgagctgggtatcgagctgtccgacttcgtcctcttctcctccgtcacaggtacggtcggcgcggccggacaggccaactacgccgctgcgaatgccttcttggatgctctggccgagcagcggcgcgccgatggtctcgcggcgacgtccatcgcgtggggtccgtgggccgagggaggcatggccgccgacgaggcgatggacgcacggatgcgccgcgagggcatgcccccgatggcgcccacatccgcgatgagcgcactggagcaggccgttggtgcgggcgagacggcgctgaccgttgccgacatcgactgggagcgtttctcctccgtcatcgccgcagtccgccccaacccgctgatcggtgacttcgtcgtcggagcggaaggcacggccgccgccagcggccacggatccgtggtcaccggcgccgatgtcgccgccaccgtctcgggccggttggcgggcctgacccaggccgagcaggagcgggaactgctcagcctggtccgtctgcacgtggccgcggtactcgggcacgacggatcggacgcggtcggtgccgaacgggccttcaaggaactcggcttcgactccctgacctccgtcgagctgcgcaaccgcctcggagccgccaccgatctccggctccccaccacgctcgtctacgactaccccacgtccgccgctctcgccgagtacctgcggggcgaactggccggcagcgcgcaggacgccgggccgcccctgcccgccgtggtcggctccgccgccgacgacgatccgatcgtgatcgtctcgatgagctgccgcttccccggtggcgtacggactccggaagacctgtggcagctcctcgcggacggcacggacacggtcgccgccttcccggccgaccgcggctgggacctggacggcctctacagcgccgacccggagcgttcggggacctcgtacacgcgtgaaggcgggttcctctacgacgccgccgacttcgacgcggacttcttcgggatctcgccgcgcgaggccctcgccatggacccgcagcagcgcctgctgctcgaaaccgcctgggagaccttcgagcgcgccgggatcgacccggcgtcgctgcggggcagccaggccggtgtcttcgtcggcaccaacggccaggactacctctcgctggtcacgcgcgaaggcgacggactcgacggactcgaaggacatgtcggcaccggcaatgcggccagtgtcgtctccggccggctctcttacgtcttcggtctcgaaggcccggcgatcacggtcgacacggcctgctcgtcgtcgttggtcgccctgcacctggccgtgcaggcgctgcgccagggcgagtgcaccttggcgctcgccggtggtgtgacggtgatgtccactccggacgccttcgtcgacttcagccgtcagcgtgggctcgcggaggacggccgtatcaaggcgttcgcgtcggccgcggacggtacgggctggggtgagggcgtcggcatgctcctggtggagcggctgtccgacgcccgtaggaacggtcacccggtcctggcggtcgtgcggggctcggcgatcaaccaggacggcgcgagcaacggcctgaccgcgccgaacggtccgtcccagcagcgcgtcatccgccaggcgctggccggtgcggggctgtcggccgccgacgtggacgcggtggaggcgcacggtacgggcacccggctcggtgacccgatcgaggcgcaggcgctgctcgccacgtacggccaaggccgcccggcggaccggccgttgtggctgggctccgtgaagtcgaacatcggtcacacgcaggccgccgcgggcgtggcgggcgtgatgaagatggtcatggcgatgcggcacggtgtgctcccgcgcacgctgcacgtggacgggccgaccccgcacgtcgactggtcggcgggcgacgtcgccctgctgaccgagcagcgggagtggccggcgaccggccacccgcggcgggcaggtgtgtcctcgttcggcctgagcggtacgaacgcccacaccatcatcgaagaagccccggccgacgacgacgccgagcccacgaccggcgcggggacggccccgtccgttctgccgctgctcatctctgccaagagcgacgccggcctgcgcgcacagtcggagcagctggcgacccatctggtcggaaacccggacgtccccatcggggacatcgcctactccctcacgaccggacgctccgggctggagacgcgagcgatcctggtcggcgacgccgacaaccgcacagggctcgcggccgcgctgcgaagcctcgctgccggcgagcaggctccgggcctggtccagggcacggtgaccgagggcgggctggcgttcctgttcacggggcaggggagccagcggctggggatgggccgtgagctgtacgagacgtatccggtgttcgcggatgcgctcgacgcggtgtgcgcgcggatggatctcgaagtcccgctgagggacgtgctgttcggggcgtatgcgggtctgctggatgagaccgcgtatacgcagcctgcgttgttcgcggttgaggtggcgttgttccggctggtggagagctggggtctgaggccggacttcgtggcgggtcattcgattggtgagatcgctgctgcgcatgtggcgggggttctgtccctggatgacgcctgtgctctggtggaggcgcgtgggcggttgatgggtgcgctgcctggtggtggcgtgatgatcgcggtccaggcgcctgaggctgaagtcctgccgctgctgaccgagcgcgtgagcattgccgcgatcaatggtccgcagtcggtcgtgatcgcgggtgacgaggccgacgcggtggcgatcgtggagtcgttcacggggcgtaagtccaagcggctcacggtcagccacgcgttccattcgccgcacatggacggcatgttggaggacttccgggccgtggcggaagggctgtcgtacgaggccccgcgcatccctgtggtttccaacctcaccggggccctggtctcggatgagatggggtcggctgagttctgggtgcgtcatgtccgcgaggcggttcgcttcctggacgggatgcgtgttctggaggccgccggggttacgacgtacgtcgagcttggcccggggggtgtgctgtcggcgctggcgcaggagtgtgtcagtggggacggtgctgctttcgtgccggtgctgcgttctggccgtcccgaggccgagaccgcggtcaccgcgttggcccaggcacatgtgcggggtgtggacgtcgactgggccgcgttcttctccgggaccggcgtccagcgggtcgacctgcccacctacgccttccagaggcagcggttctggcccgcgatgacggcggagagtgcgccggtcggcgggacggtcgacgcggtggacgcccacttctgggatgtcatcgagcaggaggacgtcgagtcccttgctgagttgctcggtctcgacgacgcgagcgcgtgggggagtgtggtccccgcgctctcggcctggcgtcggcagggccaacagcaggcccaggtcgacggatggcgctaccgggcgagctggaagccggtgacggctgcggtgtcgtccggcgtggtgagcgggacatgggttgtcgccgtacctgccggatctgcgggggacgacgcgcgggtcgaggccgtgaccaacgggctggctgggcgtggcgttgacgtccgtcgggttgtggtcgaggcgggtgtggaccgggccgcgctggctgggttgctggctggtgagggatctctcgctggtgtggtgtcgcttctcgggctggatgagtccggggggctggcggctactgctggtttggtgcaggcgttgggtgatgccggggtgtcggcgccgttgtggtgcctgacccgcggggctgtttccgtcggtcgttcggatcggcttgtgtcgccggttcaggcgcaggtgtggggtctggggcgggttgctgctctggaggttcccgagcgttggggcgggctggttgaccttccggaagtgctggatgagcgggctgtgtcccgcttgatcggtgtacttgcgggttccggtgaggatcaggttgcggttcgttcgtctggtgtcttcggtcgtcgtctggtgcgtgcaccgcgggccgagggtgctgcgtcgtggactccgaccggcacggttctcgtcaccggtggcacgggtgtgctgggtggccgggtggcgcgttggctggcgggggcgggtgctgagcgtctggtgctgaccagccgtcgtgggctggatgcgccgggtacggctgaactggtcgaggagctgaccagctccggggtggaggtgtcggtcgtcgcgtgtgacgcggccgaccgtgacgccctgcgcgccctgctctcctctgaggccgggtctctgaccgctgtgatccacacggccggtgtcctggacgacggtgtcctggatgctctgacgccggaccgtatcgatggtgtcgtgcgtgcgaaggccgtctcggctctcaacctgcacgaactgacggccgagctgggcatcgagctgtccgccttcgtcctgttctcgtccatgagcggcacggtgggcacggcgggtcaggccaactacgcggctgccaatgcctacctggatgctctggccgagcagcgccgggcggacggtctcgcggcgacgtccatcgcttggggtccgtgggcggagggtggcatggccgccgatgcggcgctcgaagcccgtatgcgccgagacggggtgcctccgatgcccgcggatccggcgatccgcgctctccggcaggccgttgcaggcgacgacgccgtgcttaccgttgccgatgtcgaatgggaccggttcctcccgggcttcgtcgccgcacggcacagcgagctgttcagcgagctgcgtgacgtccgtgatgcccgcgcggcacaggatcgggcgcaggccgccgttgccgccgaccgtccggactccctttccgggcggctgtccgcccaggcgccggccgagcaggagcgagagctgctggacctggtccgtacgcaggtcgccgccgtgctcgggcacgccggagtggaaaacgtgggcgcggggcgggcgttcaaggagcttggcttcgactcgctcatggccgtcgagctgcgcaaccgcatcggctcggccaccgagcttcggctcccggccaccttgatctacgaccaccccacgtccgccgccctcgcggagttcctgcggggtgagctggtcggcaccgtgcgggtcgccgacaaggtgctgcccgccgtggtctccgccgacgaggatccgatcgcgatcgtctcgatgagctgccgcttccccggtggcgtacggactccggaagacctgtggcggctcctcgtggacggcacggacgccgtcggcgcgttcccggccgaccgcggctgggacctggacaggctctacagccccgacccggaccagccgggcacctcgtacacccgcgaaggcgggttcttcgacggggccgcggacttcgatcccgggttcttcgggatctcgccgcgcgaggcgctcgccatggacccgcagcagcgactgctgctcgaaacctcctgggaggcgatcgagcgggcgggcatcgacccgtcgtcgctgcgcggcagccaggccggtgtcttcgtcggcaccaacggccaggactacctctccctcatcacccgtgaatcggagggcctggaaggtcacttgggcacgggtaacgcgggcagcgtcatgtccggccgcgtctcctacgtgctcggcctggagggtccggcggtcacggtcgacacggcgtgctcgtcctcgctggtcgccctgcactgggcgatccaggccctgcgtcagggcgagtgcagcatggctctggccggcggcgtgaccgtcatgtcgacgcccgagaacttcgtcgacttcagccgtcagcgcgggctcgcggaggacgggcgcatcaaggcgttcgcgtcggccgcggacggtacgggctggggtgagggtgtcggcatgctcctggtggagcggctgtcggatgcccggcgcaacgggcatccggttctggcggtagtacgtggttcggctgtcaatcaggacggtgcgagcaatggtctgacggctccgaatggtccttcgcagcagcgggtgatccgtgcggcgctggcgagtgcaggtctgtcggccgctgatgtggatgtggtggaggcgcacggtacggggacgaagctgggtgacccgatcgaggcgcaggcgctgctggcgacgtacgggcaggaccggcccgcgggccgtccgctgtggctgggttccatcaagtcgaacatcggtcatacgcaggccgccgccggtgtcgcgggcatcatcaagatggtcctcgccatgcagcacggcgtgctgccgcagacgctgcacgtcgacgagccgaccccgcacgtcgactggtcggcgggcgaggtcaccctgctgaccgagcagacggcctggccgacggtggaccggccgaggcgagcgggagtgtcgtccttcggcatcagcggcaccaacgcccacaccatcatcgaacaggccccggcggtcgagcagttggcggacggtgacgcgactcccgccactccggccctcgcgctcccgctgccgtacgtcctctccgcgaagagccccgaggccctgcgcgcccaggcgtccgtactgcgcacgcacctggaggccacggaccacaacgggcccggttccgacgacctggccttctcgctcgccacggcacgtgcgcacctcgaacaccgcgcagtcctgaccgccgacgacccacaggaattccgggaggcactcgcacgcctcgccgacggtgatccctcaccgaggatcaccaccggggcggtgagcgacggtcgtacggcgttcctgttcacgggccaggggagtcagcggctcgggatgggccgtgagctgtacgaggcgtatccggtgttcgcggacgcgcttgacgcggtctgcgcgcatgtggacgcgcacctcgaagtgcccctgaaggacgtcctgttcggggcggatgcgggtctgctggaccagacggcttacacgcagcccgcgttgttcgcggtcgaggtggcgttgttccggctggtggagagctggggtgtgaagccggacttcgtggccggtcattcgatcggtgagatcgcggccgcgcatgtggcgggcgtcttctcgctccaggacgccagtgaactggtcttcgctcgtgggcggttgatgcaggcgctgccgaccggtggcgtgatgatcgcggtccaggcgtcggaggacgaggtcctgccgctgctgaccgaccgggtgagcattgccgcgatcaacggcccccagtcggtcgtcatcgcgggcgacgaggccgacgcggtggccatcgccgagtccttcacggaccgcaagtccaagcgcctcacggtgagccacgcgttccactcgccgcacatggacggcatgctcgacgccttccgtgagatcgccgagggcctctcctacgaaccttcgcgcatcccggtcgtctcgaacctcaccggcgctctcgtctccgatgagatgggctcggccgagttctgggtgcggcacgtccgcgaggccgtccgtttcctcgatggcatccgcacgctggaagccgcgggcgtcaccaagtacgtcgaactcggccccgacggcgtgctgtcggcgatggcccaggactgcgtgagtggcgagggctccgtcttcatccccgtgctccgcaaggcgcgccccgaggccgagagcgtcacgaccgccctcgcctcggcccacgtccacggcatccccgtcgactggcaggcgtacttcgccgggaccggcgcccagcgcgtcgacctccccacctacgccttccagcgccagcgctactggcccagcgctgccgcgttcgtcaccggcgatccgacggcgatcgggctcggggatgccgggcacccgttgctgggtgcggcggtggcgctcgccgactccgagggcgtgctcttcaccggccgcctgtcgctcgacacccacccctggctcgccgaccacaccatcctcggcagcgtcctgctgccgggcacggccttcgtcgacctggcgatccgggccggcgatcaggtcggatgcgatgtggtcgaggagctgaccctcgaagcgcccctcgtcgtcccccagcggggcggtgtgcagctccagctcgtcgtcgaggcgccgagcgggcccgggcagcggccgttcagcgtgcactcccggcggcaggacgcctacgcggaggagccgtggatgcggcacgcctccggagtgctgacttccggcgtttcccgccgcgaactgtccgtggaaggcggggagttcgaggcgctggccgtctggccgccgaccggagccgtacccgtggacgtacgaggtctgtacgaggagctcgccgaggccggtgtggcctacgggccgctgttccaggggctcaaggcggcgtggcggcgggacggtgaactgttcaccgaggtggcgctcccgggtgaagcccggcgtgaggcggcacggttcggtctgcacccggctctgctggacgccggtctgcacgccatcggccacggcgagggaccggaaccggcaatgaccggcgcgctgttgcccttctcctgggcaggagtctcgctgtacgcggcgggcgcctcctcactcaggatgcggctgaccccgcacacacccgacgacgcccacaccatggcgttgctcgtggcggatgagaccggacgtccggtggcggccgtggagtcgctgatcctgcgtaccgcgtcggccgaccaggtgcgcgcggccgacggaggtcacctcgactccctcttcaaggtggagtggctgcccgtggcgggcggagccacgccgcacggcgactccaccggacggcgatgggccgtcctgggccgcgacggactcggcctgccggccaccggcgtgcaggggcaggtggccgagtacgacgatgcctccgcgctcggtgcggcgctcgcggccggcgaaccggtgccggacgccgtgttcgtccaccctggggctcttccggggcaggacacggacaccacggcggcctccgtacacgccgccgtgacggacgcgctgtccttcgtacaggaatggctggcggacgagcggttcgccgccacgcgcctggtgtggctgacatccggcgcggtggcggacgagcccggcgcgggcgtccgggacctggcgggcagcgccgtacgcggcctgctgcgctcggcgcagtccgagaaccccggccagctgctgatgctcgacctcgaccaggacccggcctcgctcgcggcgctgcccgccgcgctggccgcgggtgagccggaactggcgatacgacgcggagaactccgtaccccgcgcctgacgcgcgtcccctcggcggacgccgcggcagagccgctcggcacactcggcgacccgtccggcacggtactcgtgaccggagccaccggaaccctgggcggactcttcgcccgccatctggtgacggcgtacggggtgcggcgactgctgctcaccagccgtcgcggccccgaggccgaaggtgcggccgaactggtcgccgaactggagcagttgggggcgcacgtcgaactcgtcgcctgcgacgccgccgaccgctccgcgctcgccgcgctcctcggagccgtaccgtccgagcacccgctgacggccgtggtgcacacggcaggcgtactggacgacggcatcctctcctcgctcacccccgagcgcgtggccgccgtactgcgtccgaaggtggacgccgcctggaacctgcacgagctgacgcgggaactcggcctctcggcgttcgtgctcttctcgggcgccgccgccgcgttcggcgcggccgggcaggggaactacgccgccgccaacagcttcctggaagccctggcggagcagcgccgcgccgaaggcctgcccgccacctcactcgcgtggggcctgtgggctccgcagacgggcggcatggcccagcagctggacgaggtcgacctgcggcgcatcgccagggacggcgtcggcgggctctccggtgacgagggcctcggcctcttcgacaccgcgatgacggtcgacgcggcggtcctgctgcccatgcggctcgacctcgcggtggcgcgggcgcaggccgtctccacgggcgagacaccggcgctgctgcgcgccctcatacgggtgcccgcgcggcgcgcggtcgagcagcgtacggcggcggacggggcctcgcccctggcggccaggctgtccgccctgccggacgcggaacgcgaggacatgctgctggacctggtgtgcgggcgggtggccgaggtcctcggccacaccgacgcccgcgcggtcgacgcggaccgcgcgttcaaggaactcggattcgactccctcacggccgtcgagctgcgcaacgtcctgaaggccgcgaccggcctcaggctctcaccgaccctcgtcttcgactatccgaccccggtggcgctggcccggcacctgctcgccgagctggcgggaaccgccgatgaccaggacgccgtacgcggccggaaggcacccgcacggcccgccacggccgcggtcacctccgtgaccggcgaagacccgatcgtcatcgtcggcatgggctgccgcttccccggcggcgtacggtcgccggaggacctgtggcagctcgtcgccaccggcggcgacggcatcaccggcttcccgtccgaccgcggctggaacgtcgaggccctctaccaccccgacccggaccacgcaggcacctcgtacacccgcgaaggcggcttcctgcacgacgccgccgacttcgatcccgggttcttcgggatctcgccgcgcgaggccctcgccatggacccgcagcagcgcctgctgctggaaacctcgtgggaggcgttcgagcgggccggaatcgacccggcgacgctgcgcggaagccgtacgggcgtcttcgccggtgtcatgtaccacgactacgtgaccggcatcggcgacggcggcagcgccgtcgaactgcccgagggggtcgagggctacctcggcaccggcaacgccggcagcatcgcctccggccggatcgcctacaccttcggcctcgaaggcccggcggtcaccgtcgacacggcctgctcctcgtcgctcgtcgccctgcactgggcgatccaggcgctgcgcagcggcgagtgcacgatggcactggccggcggtgtcgccgtcatggccacccccgagaccttcgtcgacttcagccgccagcgcggcctctcggccgacggtcgctgcaagtccttcgccgcggcggcggacggtacgggctgggccgaaggcgcgggcatgctcctggtggagcgcctctccgacgccgaacgcaacgggcacccggtcctggccgtggtccgcggctcggcgatcaaccaggacggcgcgagcaacggcctgaccgcaccgaacggtccgtcccagcagcgcgtcatccgcgaggcgctggccagtgccgacctgtcggccgccgacatcgacgcggtcgaggcccacggcacgggcacccggctcggcgacccgatcgaggcgcaggcactcctggccacgtacggccgtgagcgcgaggcgggccgcccgctgtggctcggctcgatcaagtcgaacatcggtcacacgcaggcggcggccggtgtcgcgggcatcatcaagatggtcatggcgatgcggcacggcgtactgccgcagaccttgcacgtcgacgagccgtcaccgcaggtcgactgggaggccggtgaggtctccctgctgaccggggcgatgccctggccgcagacgggccgtccgcgccgtgcgggcgtgtcgtcattcggcatcagcggcaccaacgcccacacgatcatcgagcagccgccgacccgtgaggtgacgccgacggttccggtggctccggtggttccgacggttccgacggttccggtggtgccgtgggtgctctcgggcaagggcgaggaggcgctgcgagcgcaggcacgtcagctccagtcgtacgtgctccgcgcaccggaactgcgtccggtcgacatcgccggctcgctggcggtgggccgggcgtccttcgaggaccgcgcggcggtggtcgccgccgaccgcgaggggcttctggccgcccttgcggcgctggcggacggcggctcggcgacgggggctgtggagggttccgcggtgggcgggaagctggcgttcctgttcacggggcaggggagccagcggctggggatggggcgcgagctgtacgaggcgtatccggtgttcgcggaggcgttggatgcggtgtgtgctcgtcttgaactgcctttgaaggatgtgttgttcggggcggatgcgggtctgctggatgagaccgcgtatacgcagcctgcgttgttcgccgttgaggtggcgttgttccggctggtggagagctggggtctgaggccggacttcgtggcgggtcattcgattggtgagattgctgccgcccatgtggcgggggtgttctcgctggatgacgcctgtgctctggtggaggcgcgtgggcggttgatgggtgcgctgcctgcgggtggcgtgatgatcgcggtgcaggcgtcggaggacgaggtcctgccgttgttgaccgaccgggtgagcattgccgcgatcaacggtcctcggtcggtggtgatcgcgggtgacgaggccgacgcggtggcgatcgtggagtcgttcacggggcgtaagtcgaagcggcttacggtgagtcacgcgttccattcgccgcacatggacggcatgttggaggacttccgggccgtggcggagggcctgtcgtacgaggccccgcgcatccccgtcgtctccaacctcaccggcactctcgtcaccgacgagatgggctcggctgagttctgggtgcgtcatgtccgtgaggcggttcgcttcctggacggtattcgggctttggaggctgctggggttacgacgtatgtcgagcttggccctgggggtgtgctgtcggcgctggcgcaggagtgtgtcagtggggacggtgctgctttcgtgccggtgctgcgttctggacgttccgaggccgagactgcggtgaccgcgttggcccaggcgcatgtgcggggtgtgaacgtcgactgggccgcattcttcgccgggaccggcgctgagcgggtcgacctgccgacgtacgccttccagcggcagcgctactggctgcacatcccccgcgtcgcgcagagcggggtcgccgacgaggtggacgcccggttctgggatgccgtggagcgtgaggatctggagtcgctcgcctccaccctggaggtcgacgacgagagcgcgtggagcagcgtcttgcctgcgctgtcggcgtggcgtcgggagcggcgtgcccagtccgaggtggacggttggcgttaccgggtgtcgtggaagccgctggctgaggtctcggcgtcggggttgtccggttcctgggtggtgatctcgcctgctgggagtgtggacgactcggctgtggtgagtgcgctggttgggcgtggtgctgaggtccgtcgggttgtggtcgaggcgggtgtggaccgttcggcgctggctgggttgctggccgatgcgggttctgccgcgggtgtggtgtcgcttctcgggctggatgagtctgaggggttgttggggactgttggtttggtgcaggcgttgggtgatgccggggtggaggcgccgttgtggtgcctgactcgtggtgcggtctccgtcggtcgttcggatcggctggtgtcgccggttcaggctcaggtgtggggtctggggcgggttgccgccctggaggttccggagcgttggggcgggctggttgacctgccggaagtgctggatgagcgggctgtggcccgcttggtcggtgtacttgcgggttccggcgaagatcaggtcgcggttcgttcgtctggtgtgttcggtcgtcgtctggtgcgtgcaccgcgggccgagggtgcttcggcgtggacaccgaccggcactgttcttgtcaccggtggtacgggtgtgctgggtggccgggtggcgcgttggctggcgggggcgggcgctgagcgtctggtgctgaccagtcgtcgtggtccggatgctccgggtgcggctgagctggtggaggagctgaccaccggcttcggggtggaggtttcggtcgtcgcgtgtgacgcggccgaccgtgacgccctgcgcaccctgctctccgccgaggccgggactctgaccgctgtgatccacacggccggtgttctggacgacggcgtcctcgacgcgctcaccccggaccgtatcgacagcgttctgcgtgccaaggctgtctcggcgttcaacctgcacgagctgacggccgagctggggatcgagctgtccgccttcgtgctgttctcgtcgatgagtggcacggtgggtgcggccggtcaggccaactacgccgctgccaacgcctacctggatgctctggccgagcagcggcgcgccgatggtctcgcggcgacctcgctcgcttggggtccgtgggccgagggcggcatggccggcgacgacgcgatggacgcacggatgcgccgcgaggggctgcccccgatggcgccggacgcggcactgaccctgctgcgtcagagcgtggggtccgccgatgcggcgctgatggtggtcgacgtggagtggcagcggttcgcccctgccctgaccgtcgtgcgccccagcaacctcctcgccgagttgcccgaggctcgccccgccggaacggattcccgtacgggtggcgcaacgtcctccgagggggccggctcgttcgccgagcggttggccgccctgggtggggccgagcaggacaaggagctgctgaacctggtccgtacgcatatcgccgccgtactcggacatggcggctcggaggccgtgggtgccgaacgggccttcaaggaactcggcttcgactccctgaccgccgtcgagctgcgcaacaggctcggtgccgcgaccggtgtacgtctcccggccacgctgatcttcgactacccgaccgccacggctctcgccgcctacctgcggggcgagttgctcggtacgcaggtcgtggtgtccggtccggtgtccaacggcgtcgtcgtggacgacgatccgatcgcgatcgtcgcgatgagctgccgcttccccggtggcgtacggacgccggaagacctgtggcggctgctgtcgaccggcggtgacgccatcggtgagttccccgccgatcgcggctgggatctgagtcggctctacagccccgaccccgacaagcagggcaccttctatgcccgcgcgggcggtttcctctacgacgccgccgacttcgacgcggacttcttcgggatctcgccgcgcgaggccctcgccatggacccccagcagcgactgctcctggagacgtcctgggaggccttcgagcgggcgggcatcgacccgtcgtcgctgcgcggcagccaggccggtgtcttcgtcggcaccaacggccaggactacggagcgatgctccagaccatcccggacggcatcgagggcttcctcggtacgggcaacgcggcgagcgtcgtctccggccggctgtcctacgccttcgggctcgaaggtccggccgtcacggtggacaccgcctgctctgcctcgctggtcgcccttcactgggcggtccaggcgctgcgcagcggcgagtgctcgctcgcactggccggtggcgtgaccgtcatgtcctcgcccggtgcctacatcgacttcagccgtcagcgtgggctcgcggaggacggtcgtatcaaggcattcgcggcagccgcggacggtacgggctggggcgagggcgtcggcatgctcctcgtggagcggctctccgacgcccgcaggaacggtcacccggtcctggccctggtccggggctcggccatcaaccaggacggcgcgagcaacggcctgaccgcgccgaacggcccctcgcagcagcgtgtgatccgccaggccctggccaacgcgggcttgtccgccgcggaggtggacgcggtcgaggcgcacggcaccggcacgaggctcggcgacccgatcgaggtgcaggcactcctggccacgtacggccgtgagcgcgaggccgaccagcccctgtggctcggctcgatcaagtcgaacatcggccacacgcaggcggccgccggtgtcgcgggagtcatcaagatggtcctcgccatggagcacggggtgctgccgcagaccctgcacgtggacgagccgactccgcacgtggactggtcggcaggcgatgtcgccctgctgaccgacgccgtggagtggcccgagaccggtcgcccgcgtcgagcgggtgtgtcgtcgttcggcttcagcgggacgaacgctcacacggttctggaacaggcaccgaagcccgaggagcctgaggagtctcagcagcctgaggagacgaacgcgcccgcccgaccgcatcagtccggagtcatgccgtggacgctctcggcgaagagcgaggcggcgctgcgggtccaggccgagcggctgcggacgcgcatcgcttccgacccgctgctccagcccgtcgacgtggcctactcactcgcgacatcgagggccgcccttgagcggcgcgccgtggtcgtcgcgacggaacgtgacgagttcctggccggactcaaggcgctggcctccgggcagcctgctccgggcctggtgcagggcagggtgaccgagggcgggctggcgttcctgttcacggggcaggggagccagcgactggggatgggccgggagctgtacgagacgtatcccgtcttcgcggatgcgctcgacgcggtgtgtgtgcgtcttgaactgcccttgatggatgtgctgttcggaaccgagcgcgacgcgctggacgagaccgggtacacccagccggctctcttcgcggtcgaggtggcgttgttccggctggtggagtcgtggggtgtgaggccggacttcctggccgggcactcgatcggtgagatcgcggccgcgcatgtggcgggagtgttctcgctggatgacgcctgcgctctggtggaggcgcgtgggcggttgatgcaggcgctgccgaccggcggcgtgatgatcgccgtccaggcgtctgaggccgaggtcctgccgctgctgaccgagcgcgtgagtatcgccgcgatcaatggtccgcagtcggtcgtgatcgcgggtgacgaagccgatgcggtggccctcgtggagtccttcacgggccgcaagtccaagcggctcacggtcagtcacgccttccactcgccgcacatggacggcatgctcgccgacttccgcaaggtggcggaggggttgtcgtacgaggccccgcgtatcccggtcgtttcgaacctcacgggggccctggtcaccgacgagatgggctcggccgacttctgggtgcggcacgtccgcgaggccgtccgcttcctggacggcacccgcacgctggaagccctgggcgtcacgacgtacgtcgaactcggccccgacggggtcctgtcggcgatggcccaggagtgtgtgaccggcgaggactccgtcttcgtgccggtcctgcgctcgggtcgtcccgaggccgagagcgtcaccacggccctcgcccaggtacacgtccgcgggatcgccgtcgactggcaggcgtacttcgccgggaccggcgcccagcgcgtcgacctcccgacctacgccttccagcgccggcgctactggttggaagaggctcccgccacggcggccgtcgagcccctgaccggctcgctcggggccgtggacgcgcagttctgggcggccgtcgacaacgcggatctctccgcgctcaccgccaccctggacatcgacgtcgacgccgaccagccactgagcgccctgctgcccgcactgtccgcctggcggcggcagcgtcaggagcagtcggtcgtcgacggctggcgctacacggtcacatggaagccgatggccgatccggccgtcgcacggccgaccgggacctggctcgtcgtgacccccgccaccagccttgtcgacctgcccgcggtctccgccgcgttggcagcgcagggagtggacgtacgggaagtcgccctggaggcggccgagttggatcgcgacggcgtggcgggccggatgcgtgaggcgctcgcgggcgaccgggccgacggggtgctgtccctgctggcgctcgccgaacacccgcacccggcccatccggcggcgcccaccgggctgctcctgaccgggacgctcgtacaggcactcggtgacgccggagtcgacgccccgctgtggtgcctcaccaccggcgccgtggcgaccgcaccctccgacctgatcgggagcgcggcgcaggcgcaggtctggggcctcggccgggtcgtcgccctggaacaccccgagcgctggggcgggctcgtggacctgcccgtaccggcggacgagcgggcactcgaccggctgctcgccgtcctcgcgggcgccggggacgaggaccagatcgccgtacggtccgcgggcctcctcgcccgccgcatcgggcacgccgcgcctcccgccgccgggcagcacgccgacagcgggacatcgggcgccggcgctgcggccggctccgcctggcggccgcgcggcaccgtcctggtcaccggaggcacgggcgcgctcggcgggcacgtcgcccgctggctcgcggcacacggcgcggaacacctggtgctgctcagcaggaggggcccgcaggcgcccggcgccgatgccctggtcgccgagatcgccgcgctgggtgccggggccacggccgtcgcctgtgacgtgaccgaccggaccgccgtgtcggagctgctcgccgggctcgccgacggcacgtacggtcccggcctcaccgccgtcttccacacggcgggcgccgggcagttcgcgccgctcgacgggaccggccccggcgaggtcgccgaggtcgtcgccgccaaggtcgcgggcgccgcccacctcgacgagctgctcggggacacggaactggacgccttcgtcctcttctcctccatcgccggcgtctggggcagcggcggccagagcgcctacgcggcggccaatgcccacctggacgccctggcccagcagcgccgggcccgcggactgacggccacgtccgtggcctggggcccgtggggcgagggcggcctggtcgccgacgacgaagcggccgaacaactgcgccgccgcggcctgcccgtcatggcgccggagctgtcgatcgccgccctccagcaggcgctggacggggacgagacggcggtgacggtggccgatgtcgactgggacctgttcgtgccggccttcaccgccgcccggccgcgtccgctgatcaccgacctccccgaggtgcgccgcgctctggcggcagagcaggacggagccgccaccgcggccggggaagcggccggcctcgaagccgagctgcgggggatgagcggaaccgaggcggagggcgtcgtcctgaacctggtccgtacgcaggtcgccgtcgttctcggacacgggggagcgacggcggtcgaggcggcccgcgccttcaaggaactgggcttcgactcgctcaccgcggtcgagctgcgcaaccgcctcagcaccgccaccggactgcggctgcccgcgagcctggtcttcgactacccgaccccggccgcactggccgcgcacatccgggcggaactcctcggcgaggacaccacgcccgaactgcccgccctcgcggagatcgacaagctggaattcctcctctcgtcggttcccgaggacaccaccgaacgcgcccgcgtcaccgcacggctcgaatcgctcctgtcgaactggaacagggcagaacgagcggtcatcggagaggacgaagaaatatccatcgaatcggcatccgccgacgacctcttcgacatcatcaacaacgaattcggaaaatcctga

SEQ ID NO: 23 - protein, 3428 aa, Streptomyces aizunensis
VASANEEKLLENLKWMTNELRRARRRLHEVEADAQEPIAIVAMSCRFPNGVGSPEDLWRLVDEGGDAITGFPADRGWDIESLADPDPDRKGTFYNTGGGFLDGATAFDPGFFGISPREALAMDPQQRQLLETSWEVFERAGIDPAAVRGSRTGVYVGAGAMGYGADLKEAPEGLEGLLLTGGATSVLSGRVSYVFGLEGPAATVDTACSSSLVALHLATQALRQRECSLALVGGVCVMPSPDVFVEFSRQRGLSPDGRCKSFAASADGTGWSEGVGVLLVERLSDARRNGHPVLAVVRGSAVNQDGASNGLTAPNGPAQQRVIRQALENARLSAAEVDVVEAHGTGTTLGDPIEAQALLATYGQDRPEGRPLRLGSLKSNIGHTQAAAGVAGIIKMVMAMRHGVLPQTLHVDEPTPNVDWTAGAVSLLTEPMPWPETGAPRRAAVSAFGVSGTNAHTIIEQAPEPDAESVSVSGSAPAAAPAVPTPVPTLVPAVLPWTLSGRSTAALRAQAARLLTTQGQDGATEPGRPLDIGYSLATTRAALEHRAVLLGRTEDDFAAALSALAEGAESAGLVQGRVTEGGLAFLFTGQGSQRLGMGRELYEAYPVFADALDAVCARLELPLKDVLFGADAGLLDETAYTQPALFAVEVALFRLVESWGVKPDFVAGHSIGEIAAAHVAGVFSLEDACALVSARGRLMGALPAGGVMIAVQASEAEVLPLLTDRVSIAAINGPQSVVIAGDEADAVAIAGSFADRKSKRLTVSHAFHSPHMDGMLEDFRLVAEGLSYEAPRIPVVSNLTGALVSDEMGSAEFWVRHVREAVRFLDGIRTLEAAGVTKYVELGPDGVLSAMAQDCVSGEGSVFIPVLRKARPEAESVTTALATAHVHGIPVDWQAFYAGTGAQRVDLPTYAFQHERYWLEPATGGAGDVSGAGLDPAGHPLLGAAVTLAGSDSVLFTGRLSLRTQPWLADHTVSGTTVLPGAAFVELAVRAGDQAGCERVEALVLDAPLALPAEGAVRVQVLVEAPDEQGRRPFTVSSQPETAPADTPWGRHARGVLAPTAPAPSFDLAQWPPAGAEAVDITDLYASHDTPGAHGPERGGLFRAVEAVWRCDGDLFAEVRLPEGGPDAQAFGLHPALLDAAAHAASVLDEQHGTGAGLGTWSDVTLHAVGAGALRVRIRSALDGTVGLDLADDLGEPVATVGGLTPRPFAQAGSGGQVVQHDALFQLDWVRLPLADRSSAPTGEWAVLGSADGFADLEALGAAVDAGAPVPPYVVVPLERQATGNGSDALHEAVHRALALVRSWLDDQRFETSRLVVLTRGAVAGPGEGVEDLPHAAVWGLVRSAETENPGRFVLADVDVDLDADLGSGVGLAAVLASGEPELLLRDGVVHAPRLNRARTATSSDAPGIDPAGTVLITGGSGTLAGIVARHLATAHGVRRLLLLSRRGADAPGAGELTAELAGLGAQVSWAACDAGDRDALAAVLAAVPAAHPLTAVVHTAGVLDDGVIGSLTPERLDTVLRPKADAALHLHELTRDLPLTAFVLFSAIAGTLGSAGQANYAAANVFLDALAQHRHDQDLPATSLAWGLWADASGMTGGLDEAQLRRMEQHGMGTLSATDGMALFDAALAAGRPVLVPARLHLPGLRNAAGPGPVAPVFRSLLGASGRRAARTRTDGGTPLAERLTRLAGPEQDRALLDLVRAQVASVLGHASAEQVDPARAFKDLGFDSLTAVELRNRLGAATGLRLPTTLVFDHPTPTALVRHLRTDLLGAAPDPGADAPGLPARVGLADDPIAIVAMSCRYPGGVRTPEELWRLVETGGDAIAGLPGNRGWDTDALHADEDGRTFAGGFLYDADSFDADFFGISPREALAMDPQQRLLLETSWEAIERAGIDPSSLRGSRAGVFVGAAYSGYDAQLEQSGVDGVLGHVMTGNAGSVMSGRVSYALGLEGPAVTVDTACSSSLVALHWAIQALRNGECSLALAGGVTVMSTPGTFSEFSQQGGLSPDGRCKAFASAADGTGWGEGVGMLLVERLSDARRNGHPVLAVVRGSAVNQDGASNGLTAPNGPSQQRVIRAALASAGLSAADVDVVEAHGTGTKLGDPIEAQALLATYGQDRPDGRPLWLGSIKSNIGHTQAAAGVAGIIKMVMAMRHGVLPRTLHVDEPTSHVDWSAGEVSLLSESAEWPLTERPRRAGVSSFGISGTNAHTIIEQAPETGTEAEPSAETLTHGTVPYVLSAKSSDALRAQARQLLAVVEAAESPRVADLAYSLATSRAGLDHRAALVADDRENLTRALAALAADEQVPGLVRGTATGGGLAFLFTGQGSQRLGMGRELYETYPVFARALDAVDARLELPMKEVLFGADADLLNETAHTQPALFAVEVALFRLLESWGVRPDVLAGHSIGEIAAAHVAGVFSLDDACTLVEARGRLMQALPTGGVMIAVQASEDEVLPLLTGQVSIAAINGPQSVVIAGDEADAVAIAESFTDRKSKRLTVSHAFHSPHMDGMLADFRKVAEGLVYENPRIPIVSNLTGTLVTDEMASADFWVRHVREAVRFLDGIRALESRGVTTYIELGPDGVLSALAQDCLTAGTGTGTAIFAPVLRAARPEAESVTTALATAHVHGTPVDWRAYFAGTGARRADLPTYPFQGRRYWPEAAAPSGAAAGLGDQAVDARFWDAVERADLGSLIGGPEIDGDQPLSSVLPALSDWRRNQQAQSQADARLYRIAWQPWSGAGRGTPAGTWLVAVPAPYADDPWVRALTDRMAEGGAEVVPLTLDVADSDPASLRARLDERLREAVGDGPVAGVLSLLALDERPHPDHPSVPVGLALTSALTSVLTPVLTEPDPEGGASGGIEAPLWCVTRDAVAAAGGDELGGAAQAQVWGLGRVVALEHPDRWGGLVDLPAVCDDRVLSRLMAVLAGSGDEDQVAVRTSGTLVRRLLRAAPTSVPSAPWTPRGTVLVTGGTGALGRHVARHLAERGAERLVLVSRRGADAPGAAETEAELSAFGAAVTLVACDVADRDALGTLVARLAADGTPVRAVVHAAGVSQPPGTGTDLPGFARVVAAKTAGAVHLDALFDAPDSLDAFVLFSSIAGVWGSGGQGAYSAANTFLDTLAERRRARGLAATAIAWGPWADGGMATEGDAEEQLSRRGLPPMDRATNLLALERAVAGREAALTVADVDWARFAPVFAAARPRPLIGDLPEVRDALRGDTPAGEGPAETASSAVLRRLTELTGADRETALLDLVREHAATALGHTSADAVAAERAFKDLGFDSLTAVELRNRLGAACGLRLPSSLVFDYPNPQALTRHLLHTLFPEGAGGPDVPALDTDPQEAELRRTLAAIPLGRIREAGLLDTLLRLAGPDTPAPATSTADESESIDTMDLQDLLDLALDGGGDPDGLNGLDSLDGPSGNDNDSNRF

SEQ ID NO: 24 - DNA, 10287 bp, Streptomyces aizunensis
gtggccagcgcgaacgaagaaaagcttctcgaaaacctgaagtggatgaccaatgagctgcggcgggcccgccgtcgcctccatgaggtcgaggcggacgcccaggaaccgatcgcgatcgtcgcgatgagctgccggttccccaacggggtgggatccccggaggatttgtggcgcctggtcgacgagggcggcgacgccatcaccggattccccgccgaccgcggctgggacatcgagtcgctcgccgatccggaccccgaccgcaagggcaccttctacaacaccggcggcggattcctcgacggggccaccgcattcgatcccggatttttcggcatatcgccccgcgaagcgctcgccatggacccgcagcagcgccagctcctggagacctcgtgggaggtattcgagcgcgcgggcatcgaccccgcggccgtacgcggcagccgcaccggcgtctacgtcggcgcgggcgcgatggggtacggagccgacctcaaggaagcgccggaagggctggagggactgctgctgaccggcggcgccaccagcgtcctgtcgggacgggtcagctacgtgttcggactggagggccccgccgccaccgtcgacacggcctgctcctcctcgctcgtcgccctgcacctcgccacccaggccctgcgtcagcgcgagtgctcgctcgcgctggtcggcggcgtgtgcgtgatgcccagccccgatgtgttcgtcgagttcagccgccagcgcggcctgtcgcccgacggccgctgcaagtccttcgccgcgtccgccgacggcaccggctggtccgaaggcgtcggtgtcctcctggtggagcgcctctccgacgcccgtaggaatggtcatccggtcctcgcggtggtgcgtggctcggccgtcaatcaggacggcgccagcaacggcctgaccgcccccaacgggcccgcccagcagcgcgtcatacgccaggccctggagaacgcccggctgtcggcggccgaggtcgacgtcgtcgaggcccacggcacggggaccacgctcggcgaccccatcgaggcccaggcactcctcgcgacctacgggcaggaccgccccgagggccgccccctgcgcctggggtccctcaagtccaacatcggtcacacgcaggccgccgcgggtgtcgcgggcatcatcaagatggtcatggcgatgcggcacggcgtactgccgcagaccctccacgtcgacgagccgaccccgaacgtcgactggaccgcgggcgccgtttccctgctcaccgagccgatgccctggcccgagaccggcgcgccccgccgcgcggccgtctccgcgttcggcgtgagcggcaccaacgcgcacaccatcatcgaacaggcccccgagccggacgccgagtccgtgtccgtgtccggctccgcgcccgcggcggctcccgccgtcccgacccctgtcccgaccctcgtcccggcggtcctgccctggacactctccggcaggagcaccgcggcgctgcgcgcccaggccgccagacttctcaccacccagggccaggacggtgcgaccgaacccgggcgtcccctcgacatcggctactcactggccaccacccgcgcagcccttgagcaccgcgcggtgctcctcgggcgtacggaggacgactttgccgccgccctctcggcgctcgccgagggtgcggagtccgcaggcctggtacagggcagggtgaccgagggcgggctggcgttcctgttcacggggcaggggagtcagcggctggggatgggccgtgagctgtatgaggcgtatccggtgttcgcggatgcgctggatgcggtgtgtgcccgtcttgaactgcctttgaaggatgttctgttcggggcggatgcgggtctgctggacgagaccgcgtacacgcagccggcgttgttcgccgttgaggtggcgctgttccggttggtggagagctggggtgtgaagccggacttcgtggccgggcattcgatcggtgagatcgcggccgcccatgtggcgggggtgttctcgctggaggatgcgtgcgcgctggtgtcggctcgtgggcggttgatgggcgcgctgcctgcgggtggcgtgatgatcgcggtccaggcgtcggaggccgaggtcctgccgctgctgaccgaccgggtgagcattgccgcgatcaatggtccccagtcggtcgtgatcgcgggtgacgaggccgacgcggtggcgatcgcagggtccttcgccgaccgcaagtccaagcggcttacggtcagtcacgccttccactcgccgcacatggacggcatgttggaggacttccggctcgtggcggagggcctgtcgtacgaggccccgcgcatcccggtcgtctcgaatctcaccggtgctctcgtctccgatgagatgggctcggctgagttctgggtgcggcacgtccgcgaggccgtccgtttccttgacggcatccggacgctggaagccgctggcgtgaccaagtacgtcgaactcggccccgacggcgtgctgtcggcgatggcccaggactgcgtgagtggcgagggctccgtcttcatccccgtgctccgcaaggcacgccccgaggccgagagcgtcaccaccgccctcgccacggcccacgtccacggcatccccgtcgactggcaggcgttctacgccggaaccggcgcccagcgcgtcgacctccccacctacgccttccagcacgagcgttactggctggagcccgccaccggcggagccggtgatgtgagcggagccgggctcgacccggccgggcatcccctgctcggcgcggccgtcaccctggccggctcggacagtgtgctgttcaccggtcggctctcgctccgcacgcagccctggctcgccgaccacaccgtgtccggtaccaccgtgctgccgggcgccgcattcgtcgaactcgccgtgcgtgccggtgaccaggcaggctgcgagcgggtcgaggcgttggtgctcgatgcgccgctcgccctgcccgcggagggcgccgtacgcgtccaggtgctcgtcgaggcgcccgacgagcagggccgccgtcccttcaccgtttcctcccagccggagaccgcgccggccgacaccccctgggggcggcacgcccggggcgtgctcgcgcccacggcccccgcaccgtcgttcgatctggcgcagtggccgcccgccggggccgaggccgtggacatcacggacctctacgcgtcccacgacacccctggcgcgcacgggcccgagcgcggtggcctgttccgtgccgtggaggccgtctggcgctgtgacggtgacctcttcgccgaggtgcgtctgcccgagggcggcccggacgcacaggccttcggcctgcacccggcgctgctcgacgccgccgcgcacgcggcctcggtactggacgagcagcacggaacgggggcagggctgggcacgtggtccgatgtgactctgcacgccgtgggcgccggcgccctgcgcgtacggatacggtcggccctcgacggcactgtgggcctggacctcgcggacgacctgggtgaaccggtggcgaccgtgggcgggttgactccgcgacccttcgcgcaagcgggttcaggtggacaggttgtccagcatgacgcgctgttccagctcgactgggtgcggctgccgctcgccgaccgctcgtccgctcccaccggggagtgggccgtactcggctctgccgacgggttcgcggacctggaggcgctgggcgcagcggtcgacgcgggtgctcccgtaccgccgtacgtcgtcgtccccttggagcggcaggccaccggcaacgggtcggacgccctgcacgaggccgtgcaccgggcgctcgccctggtgcggtcctggctggacgaccagcgcttcgagacctcgcgcctcgtggtcctgacccgaggcgcggtcgccgggcccggcgaaggcgtcgaggacctgccgcatgccgcggtgtggggcctggtgcgttcggcggagacggagaaccccggccgtttcgttctcgccgacgtagacgtagacctcgacgcggacttgggctcaggcgtgggcctcgccgccgtactcgcctccggtgagccggagttgctgctgcgggacggagtcgtacacgccccccggctgaaccgggcccgtaccgccacctcgtccgacgcccccggcatcgatccggccggaaccgtcctgatcaccggtgggtccggcacgctcgccggtatcgtcgcccggcacctggccaccgcccacggtgtgcggcgtctgctgctgctgagccgcaggggcgccgatgcccccggtgccggtgaactgaccgctgagctggccgggttgggcgcgcaggtctcgtgggcggcgtgtgacgcgggtgaccgcgacgcgctcgcggccgtactggccgccgttcccgcagcgcacccgctcaccgcggtcgtccacacggccggtgtcctcgacgacggcgtgatcggttcgctcaccccggaacgtctcgacacggtccttcgcccgaaggccgatgccgctctccacctgcacgaactgacccgcgacctgcccctgaccgccttcgtcctcttctccgcgatcgccggaaccctcggcagtgcgggtcaggccaactacgcggccgccaacgtcttcctggacgctctggcccagcaccgccatgaccaggacctgccggccacctcgctcgcctggggcctgtgggccgatgccagcgggatgaccggcggcctcgacgaggcccagctgcggcgcatggagcagcacggcatgggcacgctctccgccaccgacggcatggcgctgttcgacgccgccctcgccgccggccggccggtcctcgtcccggcccgtctgcacctccccggcctgcgcaatgccgccgggccgggcccggtggctccggtgttccggtcgctcctgggtgcctcgggccgccgggccgcgcggacccgtaccgacggcggcaccccgctcgccgagcggctgacccgcctcgccggtcccgaacaggaccgggcgctgctcgatctcgtacgggcacaggtcgcatccgtactcggccacgcctcggccgaacaggtggaccccgcacgcgcgttcaaggatctgggcttcgactccctgaccgccgtcgagctgcgcaaccggctgggcgccgccaccggactccggctgccgaccacgctcgtcttcgatcatccgacgcccaccgcgctcgtccggcacttgcgtacggaccttctcggcgccgcgccggaccccggagccgacgccccgggcctgcccgcgcgcgtcggcctcgccgacgacccgatcgccatcgtggccatgagctgccgctaccccggcggtgtccgcacccccgaggagctgtggcggctcgtcgagaccggtggcgacgcgatcgccggactcccgggcaaccgggggtgggacaccgacgcgttgcacgccgacgaggacggccggaccttcgcgggcggcttcctgtacgacgccgactcgttcgacgcggacttcttcggcatctcgccgcgcgaggcgctcgccatggacccgcagcagcgactgctgctcgaaacctcctgggaggcgatcgagcgcgccgggatcgacccgtcgtcgctgcgcggcagccgggccggtgtcttcgtcggcgccgcctacagcggctacgacgcgcaattggagcagtccggagtggacggtgtcctcggccatgtgatgaccggcaatgcgggcagtgtcatgtccggccgtgtgtcctacgcgctgggcctggagggtccggcggtcacggtcgacacggcgtgctcgtcctcgctggtcgccctgcactgggcgatccaggccctgcgcaacggcgaatgctcgctggcgctcgccggtggtgtgacggtgatgtcgaccccgggcaccttcagcgagttcagccagcagggcggcctgtcaccggacggccggtgcaaggcgttcgcgtcggccgcggacggtacgggctggggtgagggtgtcgggatgctgctggtggagcggctgtccgatgcccgtaggaatgggcatccggttctggcggtggtgcgtggttcggctgtcaatcaggacggtgcgagcaatggtctgacggctccgaatggtccttcgcagcagcgggtgatccgtgcggcgttggcgagtgcgggtctgtcggccgctgatgtggatgtggtggaggcgcacggtacggggacgaagctgggtgacccgatcgaggcgcaggcgctgctggcgacgtacgggcaggaccggcccgatggccgtccgctgtggttgggttccatcaagtccaacatcggtcacacgcaggccgccgccggtgtcgcgggcatcatcaagatggtcatggcgatgcggcacggggtgctgccccggaccctgcacgtcgacgagccgacctcgcatgtggactggtcggcgggcgaggtgtccctgctgtcggagtcggccgaatggccgctcaccgagcggccccggcgagccggagtgtcgtccttcggcatcagcggcaccaacgcccacaccatcatcgagcaggcgccggagaccgggaccgaggcggagccgtcggcggagaccctcacgcacgggaccgtgccctacgtcctctccgccaagagctccgacgctctccgcgcccaagcgcggcagctgcttgccgtggtggaagccgccgagagcccccgagtcgccgatctggcctactcgttggccaccagtcgggccggtctcgatcaccgcgcggcgctcgtcgccgacgaccgggagaacctgacgcgggcgctcgcggccctggcggcggacgagcaggtgcccggcctggtgcggggcacggccaccggtggcggcctcgccttcctgttcacggggcaggggagtcagcggctggggatgggccgggagctgtacgagacgtatcccgtcttcgcgcgggctctcgacgcggtggacgcacgcctggaactgcccatgaaggaggtgctgttcggcgcggacgcggatctgctgaacgagaccgcccacacgcagccggctctcttcgccgtcgaggtggcgctgttccgtctgctggagtcgtggggcgtgcggcccgacgtcctggccgggcactcgatcggtgagatcgccgcggcccatgtggccggggtgttctccctggacgatgcgtgcacgctggtcgaggctcgcggtcggctcatgcaggcgctgccgaccggcggcgtgatgatcgccgtccaggcgtcggaggacgaagtcctgccgctgctgaccggccaggtgagcattgccgcgatcaacggcccccagtcggtcgtcatcgcgggcgacgaggccgacgcggtcgcgatcgccgagtccttcaccgaccgcaagtccaagcggctcaccgtcagccacgccttccactcgccccacatggacggcatgctcgccgacttccgcaaggtcgccgagggcctcgtctacgagaacccgcgcatccccatcgtctcgaacctcaccggcactctcgtcaccgacgagatggcttcggccgacttctgggtccgccacgtccgcgaggccgtccgtttcctcgacggcatccgcgcgctggagagccgcggggtcaccacctacatcgaactcggccccgacggggtcctctccgccctcgcccaggactgcctcaccgccgggaccgggaccgggaccgcgatcttcgctcccgtactccgggcggcccgtcccgaggccgagagcgtcaccaccgccctcgccacggcacacgtccacggcacccccgtcgactggcgggcgtacttcgccgggaccggtgcccggcgcgccgacctccccacctaccccttccagggcaggcgctactggcccgaagccgccgccccgagcggtgcggcggccggactcggggaccaggcggtcgacgcgcgcttctgggacgcggtcgagcgggcggacctgggctccctgatcggtgggccggagatcgacggggaccagccgctcagctccgtactgcccgccctctccgactggcggcgcaaccagcaggcgcagtcgcaggcggacgcccggctctaccgcatcgcgtggcagccgtggtccggggccggccggggcacacccgcgggtacctggctggtggccgtgccggcgccgtacgcggacgatccgtgggtccgtgcgctgaccgaccgcatggccgagggtggcgcggaggtcgtaccgctcacgctcgatgtcgccgacagcgacccggcgtcgctgcgcgcccggctggacgagcggctgcgcgaggcggtgggcgacggcccggtggccggtgtcctgtccctgctcgcgctggacgagcggccccaccccgaccacccgagcgtgcccgtaggactggccctcaccagcgccctcacctccgtgctcaccccggtgctcacggaaccggacccggaaggcggggcgagcggaggcatcgaagcaccgctgtggtgtgtcacgcgtgacgccgtcgcggcagccggtggtgacgaactcggcggcgccgcccaggcgcaggtctggggcctcggccgcgtcgtcgccctggagcaccccgaccgctggggcggtctcgtcgacctcccggcggtatgcgacgaccgggtcctgtcccggctgatggcggtgctcgcaggatccggtgacgaggaccaggtggcggtccgtacctccggcaccctcgtacgacggctcctgcgggccgccccgacgagcgtgccgtccgcaccctggaccccgcgcggcacggtgctcgtcaccggcggcacgggcgccctcggccgccatgtggcgcgccacctcgccgagcggggcgccgaacggctcgtgctcgtcagccgccggggcgccgacgcgcccggtgcggccgagaccgaggcggaactctccgcgttcggcgcggccgtgaccctcgtggcctgcgacgtcgccgaccgcgatgcgctcggaacgctcgtcgcgcggctcgccgccgacggcactccggtccgtgccgtggtgcacgccgccggtgtctcgcagccgccaggtacgggaacggacctccccgggttcgcccgtgtcgtggccgcgaagacggcgggagccgtccacctcgacgcgctgttcgacgcgccggactccctcgacgcgttcgtcctcttctcctccatcgccggtgtctggggcagtggcggccaaggggcctactccgccgccaacaccttcctcgacacgctcgccgaacggcgccgggcccgcggtctcgccgccacggcgatcgcctggggaccgtgggccgacggcggcatggccaccgagggcgacgcggaggagcagctgagccgacgcggcctgccgcccatggaccgggcgacgaacctgctggcgctggagcgtgccgtcgcgggccgggaggcggcgctgaccgtcgccgacgtcgactgggcgcgcttcgcacccgtgttcgccgcggcccgcccccgcccgctcatcggcgacctgcccgaggtacgggacgcactgcgcggggacaccccggccggggaaggaccggccgagaccgcttcctccgccgtactccggaggctgacggaactcaccggggcggaccgggaaacggccctcctcgacctcgtgcgcgagcacgcggcaacggccctgggccacacgtccgccgacgcggtcgcggccgaacgggccttcaaggacctcggcttcgactcgctcaccgcagtcgaactgcgcaaccgcctcggcgccgcgtgcggcctgcggctgccctccagcctcgtcttcgactaccccaacccgcaggcgctcacccggcacctgctgcacaccctcttccccgaaggggcgggcgggccggacgtaccggctctggacaccgacccccaggaagcggaactgcgccggacgctcgccgccatcccgctgggccggatccgcgaggcagggctcctggacacgctgctccggctcgccggacccgacacccccgctcccgccacgagtaccgccgacgagagcgagtccatcgacacgatggatctccaggacctcctcgacctggcgctcgacggcggcggcgatcccgacggcctcaacggcctcgacagcctcgacggccccagtggcaacgacaacgacagcaaccgattctga

SEQ ID NO: 25 - protein, 6751 aa, Streptomyces aizunensis
MTTPNEKVVEALRASLKETERLRRRNQELTDAAREPIAIVGMSCRFPGGVSSPEDLWRLVESGGDAISGFPVNRGWDIESLYDPDPDHEGTTYARDGGFLHEAADFDPAFFGISPREALAMDPQQRLLLETTWEVFERAGIDPASLRGSRAGVFVGASANAYGAGSHDLPDGVEGHLLTGTASSVLSGRLAYVFGLEGPAATIDTACSSSSVALHMAVQALRQGECSLALAAGVTVLAGPDVFVEFSRQRGLSPDGRCRSFAESADGTGWSEGAGVLLVERLSDARRNGHHILAVVRGSAVNQDGASNGLTAPNGPAQQKVIRQALESARLTPADIDAVEAHGTGTTLGDPIEAQALLATYGQGRTDGRPLWLGSLKSNLGHTQNAAGVAGIIKMVMAMRHGVLPRTLHVDEPTSHVDWSTGAVALLTEPVEWPETGRPRRVGVSAFGVSGTNVHTIIEQAPAPAPAPVADDTSEPAPAARPKALPWLLSAKGRDALRDRAAQLLAYAEEHPDLRPVDIAGSLAVGRPSFEDRAAVVAADREGLLAGLAALADGGSATGLVKGSSQLVGKLAFLFTGQGSQRLGMGRELYETYPVFAQALDAVCERLELPLKNVLFGTDSAALDETSYTQPALFAVEVALFRLVESWGLKPDFLAGHSIGEIAAAHVAGVFSLDDACALVSARGRLMGALPGGGVMIAVQASEDEVLPLLTDRVSIAAINGPQSVVIAGDEADAVAIAESFADRKSKRLTVSHAFHSPHMDGMLEDFRVVAEGLSYEAPRIPVVSNLTGALVSDEMGSADFWVRHVRETVRFLDGIRTLEAAGVTKYVELGPDGVLSALAQDCVSGEDSVFIPVLRKARPEAETVATALASAHVHGIPVDWRAYFAGTGAQRVDLPTYPFQRQRYWIEPGGRAGDVGAAGLEEAGHPLLGAAVPLADSEGFLFTGRLGRTSHPWLADHAVMDTVLLPGTAFVDLAVRAGDQVGCDVVEELTLEAPLVLPERGAVQIQMHVGAPDADGTGRRTFTLSSRTQDGAADEPWTRHAGGVLAHGAAQPAFAPVQWPPAGAEPIPTESLYADLAEVGMGYGPAFRGLTAAWRHGESVYVEVALPEETASTARDFGLHPALLDAALHALGLGVLGGVEGEGRLPFAWSGVTLHAAGADALRVHLAPAGAHGVRLEIADAAGAPVATVDSLVLRTVSEEQVRAARTAYHESVFRAEWTALPTAAESAATHGRWAVLGAADAGDSPRDALVNGLLGHLPGEVARYADLAELAAAVEAGAATPDAVFAAYARSDDDGPAAPDVSAPDVSAQAVHAATHDALALVQTWFGEEPFAGDRFAATRLVVLTRGAVAAGDGDTVTDPAHAAVWGLLRSAQSEYPDRLLLIDTDGVEDSVHALPAVLAVGEPQLALRAGSVHALRLARVAAATPEDAAAPTQYAPGSTVLITGAGGMLGGLIARRLVAEHGVRHLLLVGRRGAAAPGAEQLSAELAEAGASVTWAACDVADRDALSAVLHAIPAEHPLGAVVHTAGVLDDGVIASLTPERLSAVLRPKVDAACNLHELTRHLDLTAFVLFSSIGGVFGGPGQGNYAAANVFLDALAQHRRSQGLAATSLAWALWADSTGMAGSLDEADISRMRRGGLPPLTTAEGLELFDLAHRIDEAAPVLMRADLTALRTQAQAGTMSPLLRGLVRVPARRSASGAAGTGGESGLRERLAGLSAAERDRTLLDLVRKQVAAALGYPGPSAVEPGRSFKELGFDSLTAVELRNLLGDATGRRLPATLVFDYPTATALAGYLREEIIGDLADAVTAPALVPSAAVAGAGAGADDDDPIAIVAMSCRFPGGIASPEDLWQLLVTGRDGITGFPADRGWDLDSLYSDDPDREGTSYAREGGFLHEAAEFDASFFGISPREALAMDPQQRLLLETTWETFERAGIDPTSLRGSRTGVFVGSNAQDYLQLWLNDADGLEGHLGTGNAASVVSGRLSYTFGLEGPAVTVDTACSSSLVTLHLAAQALRRGECSMALAGAVTIMSTPGAFTEFSRQRGLAADGRIKAFAAAADGTSWSEGVGLLLVERLSDARRNGHPVLAVVRGTAVNQDGASNGLTAPNGPSQQRVIREALADAGLSAAEVDAVEAHGTGTTLGDPIEAQALLATYGQGRPDDQPLWLGSVKSNIGHTQAVAGAAGIIKMVMAMRHGVLPQTLHIDEPTPYVDWSAGDIALLTEQRAWPETGRPRRAGVSSFGYSGTNAHAVIEQAPQNAMERTPQGDNLPARTPATRTLPVLPLLVSGRTAPALRAQAERLRPAATALATGTVTNSGALEALDLGYSLATSRAALEHRAVLIGTPSDGQALASRLDALAAGEQVPGLVQGTASGGGLAFLFTGQGSQRLGMGRELYETYPVFAEALDAVCARLELPLKEVLFGADGAALDQTAVTQPALFAIEVALFRLVESWGLRPDFVAGHSIGEIAAAHVAGVFSLEDACRLVEARGRLMQALPGGGVMIAVQASEDEVLPLLTDRVSIAAINGPQSVVIAGDEADAVAIAESFTGRKSKHLAVSHAFHSPHMDGMLEDFRAVAEGLSYEAPRIAVVSNLTGALVSDEMSSAEFWVRHVREAVRFLDGIRALEAAGVTTYVELGPGGVLSALAQECVSGDGAAFVPVLRSGRSEAETVVTALAQAHVRGVEVDWAAFFAGTGAERIDLPTYAFQRQRYWPETVLSTVGPVVAEAVDAVDARFWDAVEREDLASLVAELDVDETPLGEVVPALSAWRRERRAQSEVDGWRYRVSWKPLADASTARLSGSWVVVSPDKGVDDSAVVAGLAGRGAEVRRVVVEAGVDRSALAGLLADAGSAAGVVSLLGLDESEGLLGTVGLVQALGDAGVEAPLWCLTRGAVSVGRSDRLVSPVQAQVWGLGRVAALEVPEHWGGLVDLPEVLDERAVARLVGVLAGSGEDQVAVRSSGVFGRRLVRAPRAEGAAAWTPTGTVLVTGGTGVLGGRVARWLAGAGAERLVLTSRRGPDAPGAAELVEELTTGFGVEVSIVACDAADRDALRALLSAEAGTLTAVIHTAGVLDDGVLDALTPDRIDSVLRAKAVSALNLHELTAELDIELSAFVLFSSMSGTVGAAGQANYAAANAFLDALAEQRRADGLAATSLAWGPWAEGGMAADAALEARMRRGGVPPMDAELALSALRQAIGSADAALTIVDFDWARFAPGFTAVRAGNLLAELPEAAAVMRGPENADSRPEHADSSLALRLQGMAQADQEPFLLELVRAQVAEVLGHSGAEDIEAGRAFREIGFDSLTAVELRNRLGAAAELRLPATLVYDYPTPAALAVHLRTELLGKQVVVSGPVSKVVDDDPIAIVSMSCRFPGGVRTPEDLWELLSTGGDAISDLPLDRGWDIDALYDADPSTQGTSYARAGGFLYDAADFDADFFGISPREALAMDPQQRLLLETSWEAFERAGIDPETLRGSQAGVFVGTNGQDYLSVLLEEPEGLEGHLGTGNAASVVSGRLSYVFGLEGPAVTVDTACSSSLVALHWAIQALRNGECSLALAGGVTVMSTPGTFIEFSRQRGLAEDGRIKAFAAAADGTGWGEGVGMLLVERLSDAERNGHPVLAIVRGSAINQDGASNGLTAPNGPSQQRVIRAALASAGLSAADVDAVEAHGTGTTLGDPIEAQALLATYGQDRPADRPLQLGSIKSNIGHTQAAAGVAGVIKMVLAMEHGVLPQSLHIDAPSPQVDWEAGDIALLTEQRQWPETGRPRRAGVSSFGFSGTNAHTIIEQAPASTETDRAESGSVEPDFVPLMLSAKSDVALRAQAASLRARLIAAPDMRLSDVGSTLTTGRSAFERRAALVAGGREGLLAGLEALADGGSAAGLVEGSPVSGKLAFLFTGQGSQRLGMGRELYEAYPVFADALDAVCVRLELPLMDVLFGADAGLLNETAYTQPALFAVEVALFRLVESWGLRPDFLAGHSIGEIAAAHVAGVLSLDDACALVEARGRLMGALPAGGVMIAVQASEDEVLPLLTDRVSIAAINGPQSVVIAGDEADAVAIVESFTGRKSKRLSVSHAFHSPHMDGMLEDFRVVAEGLSYDAPRIPVVSNLTGALVTDEMGSADFWVRHVREAVRFLDGIRALEAAGVTTYVELGPDGVLSAMAQECVTEGGAAFVPVLRKGRPEAETVMATLGQAHVRGVAVDWHSVYGTGAQRVDLPTYSFQRQRYWPAASSTAGGSVDRSVDAVDARFWDAVEREDLASLAAELDLDDDAPFSELAPALSAWRRERRALSEVDGWRYRVSWKPLADVSASGLSGSWVVISPAGGVDDSAVVGALVGRGAEVRRVVVEAGVDRSALAGLLADAGSAAGVVSLLGLDESEGLLGTVGLVQALGDAGVEAPLWCLTRGAVSVGRSDRLVSPVQAQVWGLGRVAALEVPERWGGLIDLPEVLDERAVSRLVGVLSGGGSGEDQVAVRSSGVFGRRLVRAPRAEGASAWSPTGTVLVTGGTGVLGGRVARWLAGAGAERLVLTSRRGPDAPGAAELVEELAGSGVEVSVVACDAADRDALRALLSAEAGTLTAVIHTAGVLDDGVLDALTPDRIDSVLRAKAVSAINLHELTAELGIELSAFVLFSSVTGTWGTAGQANYAAANAYLDALAEQRRADGLAATSIAWGPWAEGGMAADAALEARMRRGGVPPMKGEAAVNALQRALNANDTVVTVVDVEWERFAPGFTAARASTLLAELPEAQRALAPQEGDEGQDDGAVHGRGGHSLAERLAELSAAERDRLLLGLVRKEVAAVLGHAGVESIGAARAFKELGFDSLTAVELRNRLGAVTGLRLPATLIYDYPTSGALAEYLRGELLGTQAVVSGPVSNAVAVDDDPIAIVAMSCRFPGGVRTPEDLWQLLATGRDAIGEFPEDRGWDAEALFGPQFEQDAPYAREGGFLYDVADFDPAFFGISPREALAMDPQQRLLLETSWEAFERAGIDPLSVRGSQAGVFVGTNGQDYLSLVLNSADGGDGFMSTGNSASVVSGRLSYVFGLEGPAVTVDTACSASLVALHLAVQALRNGECSLALAGGVTVMSTPGAFAEFSRQRGLAEDGRIKAFAAAADGTGWGEGVGMLLVERLSDARRNGHPVLALVRGSAVNQDGASNGLTAPNGPSQQRVIRAALASAGLAPGDIDAVEAHGTGTKLGDPIEAQALLATYGQDRPADRPLQLGSIKSNIGHTQAAAGVAGLMKMVLAMQHGVLPQTLHVDEPTPHVDWSAGDIALLTERREWPETGRPRRAGISSFGVSGTNAHTILEQAPPLTEKDEAEAARPETGSAVSAWPLAGKTEAGLREQAERLLAHIDAHSELRPVDVGHSLATGRAAFDHRAVLVAGDDRSEFRRALAALASGESVAQVVQGIARPDQQVAFLFTGQGSQRLGMGRELYETYPVFADALDAVCARLELPLKDVLFGGDADRLNETAYTQPALFAVEVALFRLVESWGVRPDFLAGHSIGEIAAAHVAGVFSLDDACALVEARGRLMQALPTGGVMIAVQASEAEVLPLLTERVSIAAINGPQSVVIAGDEADAVAIVDAFNDRKSKRLAVSHAFHSPHMDGMLADFRKVAEELSYEAPRIPIVSNLTGALVTDEMGSADFWVRHVREAVRFLDGIRALEAAGVTVYVELGPDGVLSAMAQECVTGEGAAFVPALRKGRPEAETITAALAHAHTHGIAVDWQAYFAGTGAQRVDLPTYAFQRQRYWVDSFAEFDDVASAGIGSAGHPLLGAAVELPDSDGFLFTGRLSLRTHPWLADHVVADTVVVPGAAFVELAVRAGDEVGCEEVEELVLEAPLVLPEKGAVQLRLSVGGADDQGRRSVHVHSRVEAADGGGVPGGAWSRNATGLLSTGGSGSDVDSGTVIGEWPPAGAEQVDVTAVRERLAAAGLHHGPGFRTLTEVWVRGEEVFAEARLSDELSASAGRFALHPTLLDAASQALAAGTTAAASGIGGAGRLPQAWRGVRLHAGGADALRLRITAGGQDTVSVVLTDTQGAPVATVGSLVTEAVDAERYAAVPDGSHDSLFRLDWVRTTAPGRPTSADFAVLGTPGTGIGARIGGDEGFLVGALERAGLTAETYDGLAALDSAVAAGMAMPETVVVSFAAALDPASDSAADTVASVDSAEEVARLAQAVREATHRALATVQGWLDNGRFAGARLVVVTRGAVATGRDTEVEDLAHAPVWGLLRAAQTEHPDRFVLVDLDGADASVRALPGAIASQESELAVRDGVLYAPRLVRVGAEAVTGDTGGRRIDPRGTVLITGASGGLAGLFARHLVAEHGVRHLLLTSRRGAAAEGAAQLADELVALGAQVTWAACDVADRDALAALLASVPAEQPLTAVVHTAAVLDDGVVDLLTPERVDRVLRPKAEAALHLHELTKDLDLSAFVLFSAAAGTLGGAGQANYAAANVFLDALARHRTARGLTALSLVWGMWAEERGMAGRLTEAELGRAGRGGVAPLSATEGLALFDAALAADEAVLVPVRIDVPTLRARAADGGIHPMFRGLVRTPVRRSAQSAGRAAGTVPTDGAGERTLARQLAELSVAERERTVLDLVRGQVAAVLGYGSAEHIGGEQAFKELGFDSLTAVELRNRLGAAGGLRLPATLIYDYPNPAALAQHLLSEVAPDTAERKLSVLEELDRLESTFSSLAPAELSAAAGDEAAHARVAVRLQTLLAQWNDARLAEGGSGAHAIEEASDDELFALIDKKFGQG

SEQ ID NO: 26 - DNA, 20256 bp, Streptomyces aizunensis
atgacaacccccaacgaaaaagtcgttgaagcgctgcgggcctccctcaaggaaaccgagcggctgcgccgccggaaccaggagctcaccgacgccgcgcgcgagcccatcgcgatcgtcggcatgagctgccgcttcccgggcggagtcagctcgcccgaggacctgtggagactcgtcgagagcggtggcgacgccatctcgggcttccccgtcaaccgcggctgggacatcgagtcgctgtacgaccccgatccggaccacgagggcaccacctacgcccgcgacggcggcttcctccacgaggcggccgacttcgaccccgcgttcttcgggatctccccgcgcgaggccctcgccatggacccgcagcagcggctgctcctggagaccacctgggaggtcttcgaacgagccggaatcgatcccgcgtcgctgcgcggcagccgggccggcgtcttcgtcggcgcgtccgccaacgcctacggagccggctcccacgaccttcccgacggcgtggagggacacctcctcaccggcaccgcgtccagtgtcctgtccggccggctcgcctacgtcttcggcctggagggccccgccgccaccatcgacacggcgtgctcgtcctcctccgtcgccctgcacatggccgtccaggcgctgcgccagggcgagtgctcgctcgcgctggccgcgggcgtcaccgtcctcgcgggcccggacgtcttcgtcgagttcagccgccagcgcggcctgtcgcccgacggccgctgccggtccttcgccgagtcggccgacggcaccggctggtcggagggcgccggcgtcctcctggtggagcgcctctccgacgcccgccgcaacggccaccacatcctcgccgtggtccgcggctcggccgtcaaccaggacggcgccagcaacggcctgaccgcccccaacgggcccgcccagcagaaggtcatccgccaggccctggagagcgcccggctgacccccgcggacatcgacgcggtcgaggcccacggcaccggcacgaccctcggcgaccccatcgaggcgcaggcgctcctcgccacctacgggcaagggcgcacggacggccggccgctgtggctcggctccttgaagtcgaacctcggccacacccagaacgccgccggtgtcgccggcatcatcaagatggtcatggcgatgcggcacggggtgctgccccggaccctgcacgtcgacgagcccacctcgcacgtcgactggtcgacgggcgcggtggcgctgctgaccgagccggtggagtggccggagaccgggcgcccgcgccgggtcggcgtctccgccttcggcgtcagcggcacgaatgtgcacacgatcatcgagcaggccccggcccctgccccggcccccgtcgcggacgacacatcggaaccggcgcccgccgcccggccgaaggcgctgccctggctcctctccgcgaagggccgggacgccctgcgcgaccgggccgcacagctgctcgcgtacgccgaggaacaccccgacctgcggccggtcgacatcgccgggtcgctggcggtgggcaggccgtccttcgaggaccgcgccgcggtggtcgccgccgaccgcgaggggctgctggccggcctcgcggcactggcggacggcggctcggcgacgggtctcgtcaaggggtcgtcgcagctcgtggggaagctggcgttcctgttcaccgggcaggggagccagcggctggggatgggccgtgagctgtacgagacgtatcccgtcttcgcgcaggccttggacgcggtgtgtgagcggctggaactacccctgaagaacgtgctgttcgggacggacagcgctgcgctggacgagacctcgtacacgcagcctgctctcttcgccgttgaggtggcgttgttccggctcgtggagagctggggcctgaagccggacttcctggccgggcattcgatcggtgagatcgcggccgcgcatgtggccggggtgttctcgctggacgacgcgtgcgcgctggtgtcggctcgcggccggttgatgggggcgctgccgggcggtggcgtgatgatcgcggtccaggcgtcggaggacgaggtcctgccgctgctgaccgatcgcgtgagcattgccgcgatcaacggtccgcagtcggtcgtgatcgcgggtgacgaagccgatgcggtagccatcgccgagtccttcgcggaccgcaagtccaagcggctcacggtcagtcacgcgttccattcgccgcacatggacggcatgttggaggacttccgggtcgtggcggagggtctgtcgtacgaggctccgcgcatcccggtcgtctcgaacctcaccggcgctctcgtctccgacgagatgggctcggccgacttctgggtccgccacgtccgcgagaccgtccgcttcctggacggtatccgcaccctggaagccgctggcgtcaccaagtacgtcgaactcggcccggacggcgtgctgtccgccctggcccaggactgcgtgagcggcgaggactccgtcttcatccctgtactccgcaaggcacgccccgaggccgagacggtcgccaccgccctcgcctcggcccacgtccacggcatccccgtcgactggcgggcgtacttcgccgggaccggcgcccagcgcgtagacctccccacctaccccttccagcgccagcgctactggatcgagccgggcggccgtgccggagacgtgggcgcggccgggctggaggaggcggggcatccgctgctgggtgcggccgtaccgctcgccgactccgagggcttcctcttcaccgggcggctcggtcgcacctcgcacccctggctggccgatcacgcggtcatggacaccgttctgctccccggcacggccttcgtcgacctcgcggtgcgcgccggtgaccaggtcggatgcgatgtcgtcgaggagctgacgctggaagcgccgctggtgctgcccgagcgcggtgccgtccagatacagatgcacgtcggcgcgcccgacgcggacggtacgggacggcggacgttcaccctgtcctcgcgtacgcaggacggcgcggccgacgaaccgtggacgcggcacgccggcggcgtcctcgcgcacggcgcggcgcaaccggccttcgcgccggtccagtggcccccggcgggtgccgagccgatcccgacggagagcctgtacgcggacctggccgaggtcggcatgggatacggacccgcgttccgcggcctcacggccgcctggcggcacggcgagagcgtctacgtcgaggtcgcgctccccgaggaaaccgcctccacggcacgggacttcggcctgcaccccgccctcctggacgcggcgctgcacgcgctgggtctcggcgtactgggtggcgtcgagggtgaagggcggctccccttcgcgtggagcggtgtgaccctgcacgcggccggagcggacgcgctgcgcgtgcacctcgctccggcgggcgcccacggcgtacgcctggagatcgcggacgccgcgggcgcacctgtcgcgaccgtcgactcgctcgtcctgcggaccgtatcggaggagcaggtacgcgccgcgcgcaccgcgtaccacgagtcggtgttccgggcggagtggacggccctgccgaccgccgccgaatccgcggccacgcatggccgttgggccgtgctgggagcggcggacgcgggcgattcgccgcgcgacgcgctggtgaacgggctgctcggccacctgcccggcgaggtcgcgcgctacgccgacctggccgagctggcggcggccgtcgaggccggagcggccacgccggacgccgtgttcgccgcgtacgcgcggtccgatgacgacggaccggccgcaccggacgtgtccgcaccggacgtgtccgcgcaggcggtgcacgcggccacccacgacgccctcgcactcgtccagacgtggttcggtgaggagcccttcgccggggaccggttcgccgccacccgcctggtcgtgctcacccggggcgcggtcgcggcgggcgacggcgacacggtcaccgaccccgcacacgcggccgtctggggtctgctgcgctccgcgcagtccgagtaccccgaccggctgctgctgatcgacaccgacggggtcgaggactccgtacacgccctgcccgccgtgctcgccgtcggagagccgcaactcgccctgcgtgcaggctccgtacacgcgctccggctcgcccgcgtggccgccgcgacgccggaggacgccgccgctccgacgcagtacgcgcccggatcgacggtgctgatcaccggcgcgggcggcatgctcggcggtctgatcgcccgccgtctcgtcgccgaacacggcgtacggcacctgctgctggtgggccgccgcggcgccgccgctcccggagcggaacagctgagcgccgaactggccgaggcgggcgcctcggtgacctgggccgcgtgcgacgtcgccgaccgggacgccctctcggccgtactgcacgcgatacccgccgagcacccgctcggcgcggtcgtccacaccgctggtgtgctggacgacggtgtgatcgcctcactgacccccgagcggctctcggccgtgctgcgccccaaggtcgacgccgcctgcaacctccacgagctgacccggcacctcgacctcacggcgttcgtgctcttctcctccatcggcggcgtcttcggcggcccgggacagggcaactacgcggcggcgaacgtgttcctcgacgcactcgcccagcaccgccgctcccagggactcgccgccacctccctggcctgggccctgtgggccgacagcacgggcatggccggcagcctcgacgaggccgacatcagccggatgcggcggggcggcctgcccccgctgaccacggccgagggcctggaactgttcgacctcgcccaccgcatcgacgaggccgcaccggtcctgatgcgcgccgacctgaccgccctgcgcacgcaggcccaggccggcacgatgtcgccgctgctgcgcggtctcgtacgggtccccgcgcgccgcagcgccagtggcgcggccggtacgggcggtgagtccggactgcgcgagcgcctcgccggactctcggccgccgaacgggaccgtacgctgctcgacctcgtccgcaagcaggtcgccgcggccctcggctaccccggaccctccgccgtcgagcccggccgctccttcaaggaactcggcttcgactcgctcaccgccgtcgaactgcgcaacctgctcggcgacgccaccggccgccgcctccccgccaccctcgtcttcgactacccgacggcgaccgccctcgccgggtacctccgcgaggagatcatcggagacctggcggacgccgtcaccgccccggccctcgtgccgtccgcggccgtggcgggcgcgggcgcgggcgcggacgacgacgatccgatcgcgatcgtcgccatgagctgccggttccccggagggatcgcatcccccgaggacctgtggcagctgctcgtcaccggccgcgacggcatcacgggcttcccggcggaccgtggctgggacctcgacagcctctacagcgacgaccccgaccgcgagggcacgagctacgcccgcgagggcggattcctgcacgaggccgccgagttcgacgcctccttcttcgggatctcgccgcgcgaggccctcgccatggacccgcagcagcggctgctcctggagaccacctgggagacgttcgagcgcgcgggcatcgacccgaccagcctgcgcggcagccggaccggcgtgttcgtcggctccaacgcccaggactacctccagctctggctgaacgacgcggacggcctcgaaggacacctgggcaccggcaacgcggccagcgtcgtctccggccgcctctcctacaccttcggcctggagggcccggccgtcacggtcgacacggcctgctcgtcctccctcgtcaccctgcacctggccgcccaggccctgcgccgcggcgagtgctccatggcgctcgccggcgcggtcaccatcatgtccacgcccggcgcgttcaccgagttcagccgccagcgcggactcgccgccgacggccgcatcaaggcgttcgccgccgccgccgacggcacgagctggtccgaaggcgtcggcctgctgctcgtcgagcggctctcggacgcacggcgcaacggtcacccggttctggcggtggtgcggggcaccgccgtcaaccaggacggcgcgagcaacggcctgaccgcgccgaacggcccgtcccagcagcgcgtcatccgcgaggcgctggccgacgcgggcctgtcggccgccgaggtggatgcggtcgaggcccacggcaccggcacgaccctcggcgaccccatcgaggcgcaggcgctcctcgccacgtacggccagggccgcccggacgaccagccgctgtggctcggctccgtgaagtccaacatcggccacacccaggccgtggccggagccgccggcatcatcaagatggtcatggcgatgcgccacggcgtactgccgcagaccctgcacatcgacgagccgacgccgtacgtggactggtcggcgggcgacatcgccctgctgaccgagcagcgggcgtggccggagaccggccgcccgcgcagggcgggcgtctcctcgttcggctacagcggaaccaacgcgcacgccgtcatcgagcaggcaccgcagaacgcgatggagcggaccccgcagggcgacaacctgccggcccgcacccccgcgacgcggaccctcccggtgctgccgctgctcgtctccggccgcacggcgccggccctgcgagcccaggcggaacgcctgcgaccggccgcgaccgccctcgcgacgggcacggtaacgaactccggagctttggaagcactcgacctgggctactccctggccacgagccgcgccgcactggaacaccgggcggtcctgatcggcaccccgtcggacggccaggcactggcctcgcgactcgacgccctggcggcgggcgagcaggtgcccggcctggtgcagggcacggcttccggtggcgggctcgccttcctgttcacgggacaggggagccagcggctggggatggggcgcgagctgtacgagacgtacccggtgttcgcggaggcgttggatgcggtgtgcgcccggctcgaactgcctttgaaggaggtgctgttcggggcggatggcgctgcgctggatcagacggcggtgacacagccggccctcttcgccattgaggtggcgttgttccggctggtcgagtcgtggggtctgaggccggactttgtggcgggtcattcgattggtgagatcgccgctgcgcatgtggcgggggtgttctcgctggaggacgcctgcaggttggtcgaggcgcgtgggcgtcttatgcaggcgctgcctggtggtggcgtgatgatcgcggtccaggcgtcggaggatgaagtcctgccgttgctgaccgatcgcgtgagcattgccgcgatcaatggtccgcagtcggtggtgatcgcgggtgacgaggccgacgcggtggccatcgcggagtccttcacgggccgcaagtcgaagcatctggcggtcagccacgcgttccattcgccgcacatggacggcatgttggaggacttccgggccgtggcggagggcctgtcgtacgaggctccgcgtattgcggtggtgtcgaatctgacgggtgcgttggtctccgacgagatgtcgtcggctgagttctgggtgcgtcatgtccgtgaggcggttcgcttcctggacggtattcgggctttggaggctgctggggttacgacgtatgtcgagcttggccctgggggtgtgctgtcggcgctggcgcaggagtgtgtcagtggggacggtgctgctttcgtgccggtgctgcgttctggacgttccgaggccgagaccgtggtgaccgcgctggctcaggcgcatgtgcggggtgtggaggtcgactgggcggcgttcttcgccgggaccggtgctgagcggatcgatctgccgacgtacgccttccagcgccagcgctactggccggagaccgtgctgtcgaccgtgggcccggtcgttgccgaggccgtcgatgcggtggacgcccggttctgggatgcggtggagcgggaggatctcgcgtcgcttgtcgcagagctggacgtggacgagacgcctctcggcgaggtcgttcccgcgctgtcggcgtggcgtcgggagcggcgtgcccagtcggaggtggacggttggcgctaccgggtgtcgtggaagccgctggctgatgcttcgacggcgcggttgtccggctcttgggtggtggtgtcgcccgataagggtgtggatgactcggctgtggtcgccggtctggctgggcgtggtgctgaggtccgtcgggttgtggtcgaggcgggtgtggaccgttcggcgctggctgggttgctggccgatgcgggttctgctgcgggtgtggtgtcgcttctcgggctggatgagtctgaggggctgctggggactgttggtttggtgcaggcgttgggtgatgccggggtggaggcgccgttgtggtgcctgacccgtggtgctgtctccgtcggtcgttcggatcggcttgtgtcgccggtgcaggcgcaggtgtggggtctgggccgggttgccgccctggaggttccggagcattggggcgggctggttgacctgccggaagtgctggatgagcgggctgtggcccgcttggtcggtgtgcttgcgggttccggcgaagatcaggtcgcggttcgttcgtctggtgtgttcggtcgtcgtttggtgcgtgcaccgcgggccgagggtgctgcggcgtggacaccgaccggcactgttcttgtcaccggtggtacgggtgtgctgggtggccgggtggcgcgttggctggcgggggcgggcgctgagcgtctggtgctgaccagtcgtcgtggtccggatgctccgggtgcggctgagctggtggaagagctgaccaccggcttcggggtggaggtttcgatcgtcgcgtgtgacgcggctgaccgtgacgccctgcgcgccctgctctccgctgaggccgggactctgaccgctgtgatccacacggccggtgtcctggacgacggcgtcctcgacgcactcaccccggaccgcatcgacagcgttctgcgcgccaaggccgtctcggcactcaacctgcacgaactgacggccgagcttgatatcgagctgtccgccttcgtcctcttctcgtcgatgagtggcacggtgggtgcggccggtcaggccaactacgcggccgccaacgccttcctggatgccctggccgagcagcggcgcgccgatggtctcgcggcgacctcgctcgcttggggtccgtgggcggaaggcggcatggccgccgatgcggcgctcgaagcccgtatgcgccgcggcggagtaccgcccatggacgcggagcttgccctttcggctcttcggcaggccatcggttccgccgatgccgctctgaccatcgtggacttcgactgggcacggttcgcgcccggcttcaccgccgtgcgagccggcaacctgctcgccgaactgcccgaggcggcggccgtcatgcgcggcccggagaacgcggacagccgcccggaacacgccgactcgtcgctcgccctgaggcttcagggcatggcccaggccgaccaggagcctttccttctggagctcgtgcgtgcacaggtcgccgaggtgctgggacactccggcgccgaggacatcgaggcgggacgcgcgttcagggagatcggcttcgactcgctgaccgccgtcgagctgcgcaaccgcctcggggcggctgccgagctgcggctcccggccacgctcgtctacgactacccgacaccggcggccctcgccgtccacctccgtaccgaactgctcggcaagcaggtcgtcgtgtccggtccggtctccaaggtcgttgacgacgatccgatcgcgatcgtctcgatgagctgccgcttccccggtggcgtgcggaccccggaagacctgtgggaactgctgtccaccggcggcgacgccatctcggatcttcccctggaccgtggctgggacatcgacgcgctgtacgacgccgatcccagcacacagggcacttcgtacgcccgcgcgggtggcttcctctacgacgccgccgacttcgacgcggacttcttcgggatctcgccgcgcgaggccctcgccatggacccccagcagcgactgctcctggagacgtcctgggaagccttcgagcgggcgggcatcgaccccgagacgctccggggcagccaggccggtgtcttcgtcggcaccaacggccaggactacctctccgtactgctggaggagcccgaaggcctcgaaggccacttgggcaccggcaacgcggcgagcgtcgtctccggtcggctctcgtacgtgttcggcctggagggtccggcggtcacggtcgacacggcgtgctcgtcctcgttggtcgccctgcactgggcgatccaggccctgcgcaacggcgaatgctcgctggcgctcgccggtggtgtgacggtgatgtcgaccccgggcaccttcatcgagttcagccgtcagcgtgggctcgcggaggacggccgtatcaaggcgttcgcggcggccgcggacggtacgggctggggcgagggcgtcggcatgctcctggtggagcggctgtccgacgccgagcggaacgggcacccggtcctggcgatcgtgcggggctcggcgatcaaccaggacggtgcgagcaacggcctcaccgcccccaatggcccctcgcagcagcgcgtgatccgtgcggcgctggcgagcgcgggtctgtccgccgccgacgtggacgcggtcgaggcgcacggcaccggtacgacgctgggcgacccgatcgaggcgcaggccctgctcgccacgtacgggcaggaccgcccggccgaccggcctctgcagctcggttccatcaagtccaacatcgggcacacgcaggccgcggccggtgtcgccggagtgatcaagatggtgctggccatggagcacggcgtgctcccgcagagcctccacatcgacgcaccgtcaccgcaggtcgactgggaagccggtgacatcgcgctgctcaccgagcagcggcagtggccggagaccggacgtccccgccgggcaggtgtgtcgtcgttcggcttcagtggcaccaacgctcacaccatcatcgagcaggcaccggcgtcgacggagaccgaccgggccgaatccggctcggtggaaccggacttcgttcccctgatgctctcggcgaagagcgacgtcgcactccgggcccaggccgcaagcctgcgcgcacggctgatcgccgcccccgacatgcgcctgtccgacgtcggctccacgctgacgaccggccgctcggcgttcgagcgccgggcggcgctggtggcagggggccgcgaggggctgctcgcggggcttgaggcactggcggacggcggttcggcggcagggctggtggaaggttcgccggtgagtggaaagctggcgttcctgttcacggggcaggggagtcagcgtctgggcatgggccgtgagctgtacgaggcgtatccggtgttcgcggatgcgctggatgcggtgtgtgtccgtcttgaactgcccttgatggatgtgctgttcggggcggatgcgggtctgctgaacgagaccgcgtacacccagccggcgctcttcgccgttgaggtggcgttgttccggctggtggagagctggggtctgaggccggacttcctggcgggtcattcgatcggtgagatcgcggccgcgcatgtggccggggtgctgtccctggacgatgcctgtgctctggtggaggctcgggggcggttgatgggtgcgctgcctgcgggtggcgtgatgatcgcggtgcaggcgtcggaggacgaggtcctgccgctgctgacggaccgcgtgagcattgccgcgatcaatggtcctcagtcggtggtgatcgcgggcgacgaagccgacgcggtcgcgatcgtggagtcgttcacggggcgtaagtcgaagcggctatcggtgagtcacgcgttccattcgccgcacatggacggcatgttggaggacttccgggtcgtggcggagggcctgtcgtacgacgccccgcgcatccccgtcgtctcgaacctcaccggcgctctggtcaccgacgagatgggttcggcggacttctgggtccggcacgtccgcgaggccgttcgcttcctggacggcatccgggccctggaggccgcgggcgtgacgacgtacgtcgaactcggccccgacggtgttctgtcggcgatggcccaggagtgtgtgaccgaaggtggagcggcgttcgttcccgtcctgcggaaggggcggcccgaggccgagacggtgatggccacccttggccaggcacacgtcaggggcgtcgcggtcgactggcattcggtctacgggaccggtgcccagcgggtcgatctgccgacctactccttccagcgacagcggtactggccggcggcgtcttcgacggcaggtggttcggtcgacaggagcgtcgatgcggtggacgcccggttctgggatgcggtggagcgggaggatctcgcgtcgctggccgcggagctggacctggacgacgacgctcccttcagtgaactggcccccgcgctgtcggcgtggcggcgggagcggcgtgccctgtcggaggtggatggctggcgctatcgggtgtcgtggaagccgctggcggatgtctcggcgtcggggttgtccggctcttgggtggtgatctcgcctgctgggggtgtggacgactcggctgtggtgggtgcgctggttgggcgtggtgctgaggtccgtcgggttgtggtcgaggcgggtgtggatcgttcggcgctggctgggttgctggccgatgcgggttctgctgcgggtgtggtgtcgcttctcgggctggatgagtctgaggggctgctggggactgttggtttggtgcaggcgttgggtgatgccggggtggaggcgccgttgtggtgcctgacccgtggtgctgtctccgtcggtcgttcggatcggcttgtgtcgccggttcaggcgcaggtgtggggtttggggcgggttgccgccctggaggtccccgagcgctggggcgggctcatcgatctgcctgaggtgctggatgagcgggctgtgtcccgtctggtcggtgtgctttcgggtggtggttctggtgaggatcaggttgcggttcgttcgtcgggtgtgttcggtcgtcgtctggtgcgtgcaccgcgggctgagggggcttcggcgtggtctccgaccggcacggttcttgtcaccggtggtacgggtgtgctgggtggccgggtggcgcgttggctggccggggcgggtgctgagcgtctggtgctgaccagtcgtcgtggtccggatgctccgggtgcggctgagctggtcgaggaactggccgggtcgggggtcgaggtttcggtcgtcgcgtgtgatgcggccgaccgtgacgctctgcgcgccctgctctccgccgaggccgggactctgaccgctgtgatccacacggccggagttctggacgacggcgtcctcgacgcgctcaccccggaccgcatcgacagcgttctgcgcgccaaggcagtctcggccatcaacctgcacgaactgacggccgagctcggcatcgaactctccgccttcgtcctcttctcctccgtcacaggcacctggggtacggcggggcaagccaactacgcggctgccaacgcctacctggatgctctggccgagcagcggcgcgccgacggcctcgcggcgacgtccatcgcgtggggtccgtgggccgagggcggcatggccgccgatgcggcactcgaagcccgtatgcgccgtggcggagtaccgcccatgaagggtgaggcagccgtcaacgcccttcagcgggcgttgaacgcgaacgacacggttgtcaccgtcgtggatgtggaatgggagcggttcgcacccggtttcaccgccgcacgggcaagcacgctcctcgccgaactgccagaggcccagcgggcacttgctccgcaggagggcgacgagggccaggacgacggcgctgtccacggtcgcggtggtcactcgcttgcggaacggctcgcggagctgtcggccgccgagcgcgaccggctgctgctcggcctcgtgcgcaaggaagtcgccgcggtactcggtcacgccggcgtggaaagcatcggtgcggcgcgcgcgttcaaggaactcggcttcgactcgctcacggccgtcgaactgcgcaaccggctcggcgcggtcaccgggcttcggctcccggccacgctgatctacgactaccccacgtccggggccttggcggaatacctgcggggcgagttgctcggtacgcaggccgtggtgtccggtccggtgtccaatgccgtcgccgtcgacgacgacccgatcgcgatcgtcgcgatgagctgccgcttccccggcggcgtacggaccccggaagacctgtggcaactgctggcgacgggacgcgacgccatcggcgagttcccggaagaccgtggctgggacgcggaggccctgttcgggccccagttcgagcaggacgccccgtatgcgcgtgagggcgggttcctctacgacgtcgccgacttcgatcccgccttcttcgggatctcgccgcgcgaggccctcgccatggacccgcagcagcgcctgctgctcgaaacctcctgggaagccttcgagcgggccgggatcgatccgctctcggtgcggggcagccaggccggtgtcttcgtcggcaccaacggccaggactacctctcgctcgtgctgaactccgcggacggcggcgacggcttcatgagcaccggaaactcggcgagtgtcgtctccggccgactttcctatgtgttcggcctggaaggccccgcggtcaccgtcgacaccgcgtgctcggcgtccctggtcgcgctgcatctcgcggtgcaggcgctgcgcaacggcgaatgctccctggcgctcgcgggcggtgtgacggtgatgtccacgcccggcgccttcgccgagttcagccgtcagcgggggctcgcggaggacggccgtatcaaggcgttcgcggcggccgcggacggtacgggctggggcgagggcgtgggcatgctcctggtggagcggctctccgacgcccgcaggaacggtcaccccgtcctggccctggtccggggctcggccgtcaaccaggacggcgcgagcaacgggctcacggctccgaacggcccctcgcagcagcgcgtcatccgtgccgctctcgcgagcgccggcctggcacccggcgacatcgacgcggtcgaggcacacggcaccggtaccaagctcggcgacccgatcgaggcgcaggccctgctcgccacgtacgggcaggaccgcccggccgaccggcccctgcagctcggttccatcaagtccaacatcgggcacacgcaggccgcggccggtgtcgccggtttgatgaagatggtcctcgccatgcagcacggggtgctgccgcagaccctgcacgtggacgagccgaccccccacgtcgactggtcggccggtgacatcgcgctgctgaccgagcggcgggagtggccggagacgggccgtccgcgccgggcgggcatctcctcgttcggtgtgagcggtacgaacgcgcacaccatcctggagcaggcaccgccgctcacggagaaggacgaggctgaggccgcgaggccggagaccggctccgccgtctcggcgtggcccctcgcgggcaagaccgaagccggcctgcgtgagcaggcggaacggctgctggcacacatcgatgcccactccgagctgcggccggtggacgtcggtcactcgctcgcgaccggccgggcggcgttcgaccaccgtgccgtgctcgtggcgggagacgaccggtcggagttccgacgggcactggccgcgctggcgtcgggagaatccgtcgcgcaggtggtacagggcatcgcgcgaccggatcagcaagtggcgttcctgttcacggggcaggggagccagcggctggggatggggcgtgagctgtacgagacgtatcccgtcttcgcggatgcgctggacgcggtgtgtgctcgccttgaactgccgctgaaggatgtgctgttcggaggggacgcggatcggctgaacgagaccgcgtacacccagccggctctcttcgcggtcgaggtggcgttgttccggctggtggagtcgtggggtgtgaggccggacttcctggccgggcattcgatcggtgagatcgcggccgcgcatgtggcgggggtgttctcgctggatgacgcctgtgctctggtggaggcgcgtgggcggttgatgcaggcgctgccgaccggtggcgtgatgatcgcggtccaggcgtcggaggccgaggttctgccgctgctgaccgagcgcgtgagcatcgccgcgatcaacggtccgcagtcggtcgtgatcgcgggtgacgaggccgacgcggtcgcgatcgtggacgcattcaacgaccgcaagtccaagcggctcgcggtcagtcacgcgttccactcgccgcacatggacggcatgctcgccgacttccgcaaggtggcggaggagctgtcgtacgaggctccgcgcatccccatcgtctcgaacctcacgggggccctggtcaccgacgagatggggtcggccgacttctgggtgcggcacgtccgcgaggccgtccgcttcctggacggcatccgggcccttgaggccgcgggggtcacggtgtacgtcgaactgggcccggacggagtcctgtcggctatggcccaggagtgcgtcaccggcgagggtgcggccttcgtgcccgctctccgcaagggtcgtcccgaggccgagacgatcacagcggccctcgcccacgcgcacacccacggcatcgccgtcgactggcaggcctacttcgccgggaccggcgcccagcgcgtcgacctcccgacctacgccttccagcgccagcgctactgggtggattccttcgccgagttcgacgatgtcgcctcggccgggatcggatcggccggtcatccactgctgggtgcggcggtcgagctgccggactcggacgggttcctgttcaccgggcggctctccctccgtacgcacccctggctcgccgatcacgtggtggcggacaccgttgtggtgccgggcgcggcgttcgtcgagctggcggtgcgcgccggggacgaggtcggatgcgaggaagtggaggagctggttcttgaggcgccgctcgtactgcccgagaagggggccgtgcagctgcggctcagcgtgggcggggcggacgaccagggacgccggtccgtacacgtgcacagccgcgttgaggcggccgatgggggcggggtccccggcggggcgtggtcccgcaatgcaacgggtctcctctccaccggcggtagcggaagcgacgtcgactccggcacggtcatcggtgagtggccgccggccggagccgagcaggtggatgtgaccgcggtacgcgaacgactggcggccgcggggctccaccacgggccgggcttccggacgctgaccgaggtgtgggtgcggggcgaggaggtgttcgcggaggctaggctctccgacgaactgagcgcgtccgcagggcggttcgccctgcacccgacgctgctcgacgccgcctcgcaggcgctggcggccggtacgaccgccgccgcatccggcatcggtggtgcgggacggctgcctcaggcatggcgcggggtacggctgcacgcggggggagcggacgctctgcgtctccggatcaccgcgggcggtcaggacaccgtttccgtcgtcctgaccgacacgcagggtgcgccggtcgcgacggtcggctcgctggtcacggaggcggtcgacgccgagcggtacgcggcggttccggacggatcccacgattcgctgttccgcctcgactgggtgcggacgacggctccggggcggccgacctccgcggacttcgcggtgctcggtacccccggcactggcatcggcgcccgcatcggcggtgacgagggcttcctcgtcggcgcgttggagcgggcgggtctgaccgccgagacgtacgacggtctcgcggcgctcgactcggccgtcgcggccgggatggcgatgccggaaacggtggtggtgtcattcgccgcagctttggacccggcctcggactcggccgcggacacggtggcctccgtcgactcggcggaggaggtcgcgcggctcgcccaggcggtgcgcgaggcgacgcaccgggcgctcgcgaccgtgcagggctggctggacaacggccggttcgccggagcgcgtctggtcgtcgtcacccgaggagcggtggccacgggcagggacaccgaggtggaggacctcgcccacgcaccggtgtggggtctgctgcgtgccgcacagaccgagcacccggaccggttcgtcctcgtcgacctcgacggggcggacgcctccgtccgggccctgccgggcgccatcgcctcgcaggagtccgaactggccgtacgtgacggtgtgttgtacgcgccgcgcctggtcagggtcggggcggaggcggtcacgggtgacaccggcggtcgccgcatcgatccgcggggcacggtcctgatcaccggggcgagcggcggactcgccgggctcttcgcccgccatctggtggcggagcacggcgtacggcatctgctgctcaccagccgcaggggcgccgccgccgaaggtgccgcccaactcgccgatgaactcgtcgcgttgggtgcgcaggtgacctgggcggcgtgcgacgtggccgaccgggacgcgctggccgcactgctggcgtccgtaccggccgaacagccgctgacggccgtcgtgcacaccgcggccgtcctggacgacggcgtcgtggacctgctcacccccgagcgggtggaccgggtgctgcggcccaaggcggaagcggcgctccacctccacgagctgaccaaggacctcgatctgtcggcgttcgtcctcttctccgccgccgccggcacgctcggcggcgcggggcaggccaactacgccgcggcgaacgtcttcctcgacgccctcgcccggcaccgcacggcccgtggtctcaccgcgctgtccctcgtctggggcatgtgggccgaggagcggggcatggcgggcaggctgacggaggcggagctgggcagggcgggccgcggcggtgtggcaccgctgtcggcgacggaggggctcgccctcttcgacgcggccctcgccgcggacgaggccgtgctcgtaccggtcaggatcgatgtcccgaccctgcgggcccgggcggcggacggcgggatccacccgatgttccgcggactggtacggactccggtgcgcaggtcggcgcagagcgcgggccgcgcggcgggcaccgtgcccacggacggcgcgggggagcggacgctggcccggcaactggccgagctgtccgtcgccgagcgggagcggaccgtactggacctggtacgcggccaggtggccgccgtactcgggtacgggtccgccgaacacatcggcggtgagcaggcgttcaaggaactcggcttcgactcgctgaccgcggtcgagctgcgcaaccgactcggcgcggccggcggtctgaggctgcccgccacgctgatctacgactacccgaacccggccgccctcgcccagcacctgctgagcgaggtggccccggacacggcggagcgcaagctctccgtactggaggaactcgaccggctggagagcaccttctcctcgctggctcccgcggaactgtccgcggccgccggtgacgaggcggcccacgcgcgggtcgcggtacgcctccagaccctgctggcccagtggaacgacgcccgtctggcagagggcgggagcggggcccacgcgatcgaagaggcgagcgacgacgagctgttcgccctcatcgacaagaagttcggacagggctga

SEQ ID NO: 27 - protein, 1657 aa, Streptomyces aizunensis
VANEAKLREYLKKVTTDLDEAYGRLREIESQAHEPIAITAMSCRFPGGVRSPEELWELLRTGGDALTAFPADRGWDLDNLFSDDPDDHNTSVTREGGFLGEASSFDAAFFGISPREAMAMDPQQRLLLETSWEAFERAGIDPQALRGSQSGVFVGINGSDYLTPLLEAAEDYAGHLGTGNASSVMSGRLSYTFGLEGPAVTVDTACSASLVALHLAVQALRAGECSLAVAGGVHVMSTPGLFVEFSKQRGLSTDGRCKAFAAGADGFGPAEGVGVLLLERLSDARKNGRPVLAVVRGSAVNQDGASNGLTAPNGPSQQRVIRQALANARLSTDQVDVVEAHGTGTSLGDPIEAQALIATYGQDRPADQPLLLGSVKSNIGHTQAAAGVAGVIKMVLAMQHGVLPQSLHIDEPSPHVDWESGAVSLLTEQTAWPETTHPRRAGVSSFGFSGTNAHVIVEQAPVVEEVAGDPAGVVEGSGPGVVPVVPWVLSGKSAGALRAQAERLSGFLAGASAVDVPSVDVGWSLASSRAGLEHRAVVLGDHAAGVAAVASGVMAAGVVTGSVVGGKTAFVFPGQGSQWVGMAVGLLDSSPVFAARVEECAKALEPFTDWSLVDVLRGVEGAPSLERVDVVQPALFAVMVSLAEVWRAAGVRPGAVIGHSQGEIAAACVAGILSLEDAARVVALRSQAIGRVLAGLGGMVSVPLPAKAVRELIAPWGEGRISVAAVNGPSSVVVSGEAAALDELLVSCESEGVRAKRIAVDYASHSAQVELLREELAELLAPIVPRAAEVPFLSTVTGEWVRGPELDGGYWFQNLRRTVELEEATRTLLEQGFGVFVESSPHPVLSVGMQETVEDAGREAAVLGSLRRGEGGLERFWLSLGEAWVRGVGVDWHAVFAGTGAQRVDLPTYAFQSQRFWPEAAPIEAVAVSAESAIDARFWEAVEREDLEALTAELDIEGDQPLTALLPALSSWRRQSREHSTVDGWRYRVTWKRIAEPSPARLSGTWLVVVPEVGPADEWTGAVLRMLAERGAEVRTVTVPADGADRDRLAVTLKAETSEVAPSGVLSLLALAAGAGAFAAELALCQALGDADVAAPLWCVTRGAVATGRSEQVADPAQALVWGLGRVASMEQGGRWGGLLDLPADLDGRTLERLAGVLAGDGSEDQVALRASGLFGRRLVHAPLADTAAVQEWRPQGTTLVTGGTGALGAHVARWLAGNGAEHLLLTSRRGPDAPGAAALRDELTALGTQVTIASCDMADRDAVTALIAAIPADQPLTAVIHAAAVVDDGVIETLAPEQVEAVLRVKVDATLILHELTRGLDLSAFVLFSSFAATFGAPGQGNQAPGNAYLDAFAEYRRGSGLPATSIAWGPWGSADGDDSAAGDRMRRHGIIVMSPERTLVSLQHALDRDETTLTVADMDWKRFTLAFTADRDRPLLLELPEARRIIESAERESADDLAGGVPLTQQLAGLPEVEQERLLLDLVRTAVAAVLGHADLAAVEAGRAFKELGFDSLTSVELRNRLGAVSGLKLPASLVFDHPTPAAVAAFLRAGIVPDAAAGGAPLLEELDKLEAVLERGTADNVVRARVTMRLQKLLGKWNESEDQSGAEVWAAAANGSGSGIGAGSADGVLDEVEQLQEASDEELFAFINKGLGRA

SEQ ID NO: 28 - DNA, 4974 bp, Streptomyces aizunensis
gtggcgaacgaagcaaagctccgcgagtacctcaagaaagtcacgaccgatctggacgaggcgtacggacgcctgcgggagatcgagagccaggcccacgagcccattgccatcacggcgatgagctgccggttcccgggaggcgtacggtctcccgaagagctgtgggaactgctccgcaccggcggggacgcactcaccgcgtttcccgcggaccgcggctgggacctcgacaacctgttctcggacgaccccgacgaccacaacacgtcggtcacccgtgagggcgggttcctcggcgaggcgtcctcgttcgacgccgcgttcttcgggatctcgccgcgcgaggccatggcgatggacccgcagcagcggctgctgctggagacctcgtgggaggcgttcgaacgggccgggatcgacccccaggcgctgcgcggcagccagtccggtgtgttcgtcgggatcaacgggtcggactacctgaccccgctgctggaagcggccgaggactacgcggggcacctggggaccggcaacgcctccagcgtgatgtcgggcaggctctcgtacacgttcggcctggagggcccggcggtcacggtcgacacggcgtgctccgcgtcgctggtcgccctgcacctggccgtgcaggcgctgcgggccggagagtgctcgctggccgtcgccggcggggtgcacgtcatgtccacgcccggactcttcgtcgaattcagcaagcagcgcggactgtccacggacggccgctgcaaggccttcgcggcgggcgccgacggattcggcccggcggaaggcgtgggcgtcctgctgctggagcggctctccgacgcccgcaagaacgggcgtccggtccttgcggtggtccgcggttcggcggtcaaccaggacggtgcgagcaacggtctgacggctccgaacggtccgtcgcagcagcgcgtcatccggcaggccctcgccaacgcacggctctccaccgaccaggtcgatgtcgtggaggcacacggcaccggcaccagcctcggcgacccgatcgaggcccaggcgctcatcgccacgtacggccaggaccgcccggccgatcaaccgctgctgctcgggtcggtcaagtccaacatcggtcacacccaggcggccgccggtgtggccggcgtgatcaagatggtgctggcgatgcagcacggcgtgcttccgcagagcctgcacatcgacgagccgtcgccccacgtggactgggagtccggcgcggtctcgctgctcacggaacagacggcctggcccgagacgacgcatccgcgtcgtgcgggtgtgtcgtcgttcgggttcagcgggacgaacgcgcatgtgatcgtcgagcaggctccggtggttgaggaggtggcgggggatccggccggtgtggtcgagggttcgggtcccggggtggtgccggtggtgccttgggtgttgtcgggcaagagtgcgggggcgttgcgggcgcaggcggagcggttgtccggattcctcgcgggtgcttcggctgtggatgtgccgtcggttgatgtggggtggtcgttggcgtcgtcgcgtgctgggctggaacaccgggctgtggtgctgggcgatcacgcggccggtgtggcggcggtggcgtcgggtgtgatggccgcgggtgtggtgacggggtcggttgtcggcgggaagaccgcgttcgtgttcccggggcagggctcgcagtgggtgggtatggcggtggggttgctggattcctcgccggtgttcgctgcgcgggtggaggagtgtgcgaaggcgttggagccgttcaccgactggtcgttggtggatgtgctgcggggtgtggagggtgcgccgtcgttggagcgggtggatgtggtccagcccgctctgttcgcggtgatggtgtcgttggcggaggtgtggcgagccgctggtgtgcgtcctggcgcggtgatcggtcattcgcagggtgagatcgctgccgcgtgtgtggcggggatcttgtcgcttgaggatgcggcgcgggtggttgcgttgcgtagtcaggcgatcggccgggtcctggcgggtctgggcgggatggtgtcggtgccgttgccggcgaaggctgtgcgggagctgatcgctccgtggggtgagggccggatctcggtggccgcggtgaacgggccgtcgtcggtggttgtttcgggtgaggccgcggccctggatgagctgctggtctcgtgcgagtcggagggtgtgcgggcgaagcggatcgcggtggattacgcgtcgcattcggctcaggtggagttgctgcgggaagagcttgctgagctgctggctccgattgttccgcgcgctgctgaggtgccgttcttgtcgacggtcaccggtgagtgggtgcgaggcccggagctggatggcgggtactggttccagaacctgcgtcggacggtggagttggaagaggcgacgcggacgttgctggagcagggcttcggtgtgttcgtcgagtcgagcccgcacccggtgttgagcgtgggcatgcaggagacggtcgaggacgcgggccgggaggcggctgttctgggctcgttgcgtcgtggtgaggggggtctggagcgtttctggctgtcgctgggtgaggcctgggtccgtggcgtgggtgtcgactggcatgccgtgttcgcgggcacgggtgcccagcgggttgacctgcccacctacgccttccagtcgcagcggttctggccggaggccgcgcccatcgaggctgtggcggtgtcggcggagagtgcgatcgatgcccggttctgggaggccgtcgagcgcgaggacctggaggcgctgaccgcggaactcgacatcgagggcgaccagccgctgaccgcactgctgcccgcgctgtcgtcgtggcgtcggcagagccgtgagcattcgacagtggacggctggcgctaccgcgtcacctggaagcggatcgctgagccttccccggcccgcctgtcgggtacgtggctggtcgtcgttcccgaggtcggcccggccgacgagtggacgggagccgtcctgcgcatgctcgccgagcgcggcgctgaggtccgtaccgtgaccgtcccggctgacggggcggaccgtgaccggctcgccgtcacgctgaaggccgagacgagcgaggtcgctccgagcggcgttctctccctcctcgccctcgccgccggtgcgggagccttcgccgccgaactcgccctgtgccaggcgctcggtgacgccgacgtggccgcacctctgtggtgcgtgacgcgtggcgctgtcgccaccggccgttccgagcaggtggccgaccccgcgcaggcgctcgtctggggtctcgggcgggtcgcctccatggagcaggggggcaggtggggaggcctgctcgaccttcccgccgatctcgacggccgtacgctcgaacgtctcgcgggtgtcctggccggtgatggttcggaggaccaggtggcgctgcgcgcctcgggtctcttcggtcggcgtctggtgcacgcacccctcgccgacaccgccgccgtgcaggagtggcgtccgcagggcacgaccctggtcacgggcggtacgggcgcgctgggcgcgcacgtggcccgctggctcgccgggaacggcgccgagcacctgctgctcaccagccgacggggccccgacgcgcccggagccgccgcactccgcgacgaactcaccgccctcggcacccaggtcaccatcgcgtcctgcgacatggccgaccgggacgccgtcaccgccctcatcgccgccatccccgccgaccagcccctcaccgcggtgatccatgccgcggcggtcgtggacgacggggtcatcgagacgctggccccggagcaggtggaggccgttctgcgggtcaaggtcgacgcgaccctcatcctccacgagctgacccgtggcctggacctgtcggcgttcgtcctcttctcctccttcgccgccaccttcggcgcccccggccagggcaaccaggcacccggaaacgcgtacctggacgccttcgccgagtaccgccgggggtcgggactgcccgccacctccatcgcctgggggccgtggggcagcgcggacggcgacgacagcgcggcgggcgaccggatgcgccgccacggcatcatcgtgatgtcgcccgaacggaccctcgtctccctccagcacgcgctggaccgtgacgagacgaccctgaccgtcgccgacatggactggaagcggttcaccctcgccttcaccgcggaccgggaccggccgctgctcctggagcttcccgaggcccggcgcatcatcgagagcgcggagcgggagtccgccgacgacctggccgggggagtgccgctcacgcagcagctcgccgggctgcccgaggtcgaacaggagcggctgctcctcgacctggtccgtacggccgtcgccgccgtcctcggccatgccgacctggccgccgtcgaggcgggccgggcgttcaaggagctcggcttcgactcgctcacctcggtcgaactgcgcaaccggctcggcgcggtcagcggtctgaagctgcccgccagcctggtcttcgaccacccgacccccgccgccgtcgcggccttcctacgcgccgggatcgtgcccgacgcggccgcgggcggcgcgccgctgctggaggagctcgacaagctcgaagccgtactggagcggggcaccgccgacaacgtcgtacgggcccgggtgaccatgcggctccagaagctcctggggaagtggaacgagagcgaggaccagtcgggcgccgaggtgtgggcggccgcggccaacggctccgggtcgggcatcggcgcggggtcggcggacggcgtgctggacgaggtcgagcagctccaggaggcgagcgacgaagagctgttcgccttcatcaacaagggactcggccgcgcctga

SEQ ID NO: 29 - protein, 5207 aa, Streptomyces aizunensis
MANEETLRDYLKLVTADLHQTRQRLRDVEAKNQDPIAIVGMGCRYPGGVTSPEELWQLVVDGGDAISGFPADRGWDMETVYHPDPEHPGTSYANQGGFVRDFARFDPSLFGISPREALAMDPQQRLLLETSWEAFERAGIDPTSMRGKQVGVFVGTSNHDYLSALLSSSENVEGYLGTGNAASVASGRLSYTFGLEGPAVTVDTACSSSSVALHLAVQALRNGECSLALAGGATLMSAPGTFIDYSKQRGLATDGRCKAFSPDADGFSLAEGVGILLVERLSDARRKGHPVLAVVRGTAVNQDGASNGLTAPNGPSQQRVILQALSNARLTPDQVDAVEAHGTGTGLGDPIEAQALIATYGQDRPDGRPLWLGSLKTNIGHAQAAAGVAGVIKSVMAMRHGVLPRTLHVDEPTPEVDWSAGDVSLLTEARPWPLGDQPRRIGVSSFGMSGTNAHIILESAQEYADGRQADAGTAGNEPATGRTNPPGALPVVLSGRTEPALRAQAAALHAHLAAHPGLGIADLAFSQALTRAALDRRAAVVADDRDALLAGLAALAEGRPSADVVEGSATDGKLAFLFTGQGSQRPGMGRELYATYPVFAQALDAVCERLELPLKDVLFGTDGAAGAALDETAYTQPALFAVEVALFRLVESWGLKPDYLAGHSIGEIAAAHVAGVFSLEDACTLVEARGRLMQALPTGGVMIAVEASEDEVLPLLTDWVSIAAVNGPRSVVVAGDEDAAVAIAEAFAAQGRKTKKLTVSHAFHSPHMDGMLDAFRTVAQGLSYGTPRIPVVSNLTGALVTDEMGSADFWVRHVREAVRFLDGIRWLESRGVTTYIELGPGGVLSALGQDCQTATGPRAAAFLPALRTGRPEASSLTAAVAGAHVRGLSPDWTVRFAGTGAQRVELPTYAFQRELYWPRDPFTDPAESAHGGELGATDAKFWEVVDSEDLAALADTLGVGGDEPLSSVLPALSAWHRRHRDRDTVDGWRYRVTWKPLTDTTPASPSGHWLLVVPTEHADAPWAVAAERALTARGVTVSTVVLDATLDDRAATARRIGEALAASAATDSAPAGAETLAGVFSLLALEERPHPADPALSAGLAATVALIQALGDAGVEAPLWAATCGAVSTGRTDRLSSTAQAQVWGLGRTAALELPVRWGGLVDLPGTPDERAAGRLADVLGGLGGPGAEDHLAVRSTGVFVRRLARATRDERPTTEWATTGTALITGGTGALGRHVARWLARTGAQHLLLVSRRGPEAEGADALAAELRALGAEVTIAACDVADRDAVAALLATLPAEHPLTNVVHAAGVLDDGVLDAQTPQRLAGVLRPKAHAAQVLHELTRDLDLSAFVLFSSVAAVFGAAGQANYAAANASLEALAEQRRADGLPATVLAWGAWAEGGMATDELVAERLRLAGLPALAPELALSALHRALTLDETASLVADIDWERLAPGLTAVRPCPLIADLPEAVHALAGAEASTGPGAAADTFARQLADAPAGERDQLALEFVRTQVAAVLGYAGPESVDPGSAFRDLGFDSLTAVEIRNLLTSRTGLRLPATLIFDYPNSLSLAAFLQGELLGAQATDPARHTPAGPGTATDDDPIAIVAMSCRFPGGVQSPEDLWQLLSTGRDAISGFPGDRGWDLDGLYDPESAGENTSYVREGGFLAGATEFDPAFFGISPREALAMDPQQRLLLETSWEAFERAGIDPATVRGEQIGVFTGTNGQDYLNVILAAPDGVEGFLGTGNAASVVSGRVSYVLGLEGPAVTVDTACSSSLVALHWAIQALRQGECTMALAGGVTVMSTPASFIDFSRQRGLAEDGRIKAFAAAADGTGWGEGVGILLVERLSDAQRNGHPVLAIVRGSAINQDGASNGLTAPNGPSQQRVIRQALASGGLTTMDVDAVEAHGTGTKLGDPIEAQALLATYGQDRPEGRPLLLGSIKSNLGHTQAAAGVAGVMKMVLAMQHGVLPQTLHVDEPTPHVDWSAGDVALLADAVAWPETGRPRRAGVSSFGISGTNAHTIIEQAPAAVAPVPPVATTPARADGPQPWLLSAKTRDALHDQARRLHAHAELNPELSPADLGLSLAAGRSAFERRAAVIAADRDGLLAGLAALADGGAAAGLVEGSPVAGKLAFLFTGQGSQRLGMGRELYDTYPVFADALDAVCAHVDAHLEVPLKDVLFGADTGLLDQTAYTQPALFAVEVALFRLVESWGLRPDFLAGHSIGEIAAAHVAGVFSLQDASELVVARGRLMQALPTGGVMIAVQASEDEVLPLLTDRVSIAAINGPQSVVIAGDEADAVAIAESFTGRKSKRLTVSHAFHSPHMDGMLEDFRAVAEGLSYEAPRIPVVSNLTGALISDEMGSAEFWVRHVREAVRFLDGIRTLEAAGVTKYVELGPDGVLSAMAQDCVSGEGSVFIPVLRKARPEPESVTTALTTAHVHGIPVDWQAFFAGTGARRVDLPTYAFQRQRYWPAVSSLYLGDVEAIGLDDTAHPLLSAGVALPESDGMVFAGRLALSTHAWLADHAILGSVLLPGTAFVELATRAGDQVGCDYLEELTLEAPLVLPEHGGVQLRVWVGAADESGRRPFALHSRAEGLPVEEPWTRHAGGVLAEGGRPPADFDLTAWPPPGAVEVDLDGRYDQLDGIGFAYGPTFRGLRTAWQLDGEIYAEVRLPEGAEGEAGRFGLHPALLDAALHAIGLGGLGADDGQGRLPFAWSGVSLHAGGAAALRVHLAPAGAEGVRLEIADASGAPVAAVESLGLRPVTAEQLRAARATYHESVFRQQWTELPGLGAPAATPAVRYAFLGGDSGDSGDSGDTAAADRHQDLAALAAAIDAGRPVPDEVVVELAAAPWAVSASAVHSAAHDALALIQTWLADDRFAAARLVFLTRGAVAADAGDDVTDLAAATVWGLLRSAQTENPGRIALVDTDGHDRSEQALRAALTSDEERFALRAGAVLVPRLARVEIQQDDSARTPALTPGGTVLITGATGALGGLFARHLAAEHGVERLLLVGRRGADAPGAAELVAELAESGTLATWAACDVADRDALAALLADIPAEHPLTAVVHTAGVLDDGVISSLTPERLSAVLRPKVDAAWNLHELTRGLDLAAFVLFSSTSGLFGGPGQGNYAAANSFLDALAQHRRAHGLPATSTAWGLWSVADGMAGALDAADVNRMRRAGLPPLTAADGLGLFDTAVSLDEASLALMRVDTEVLRTQAGAGTIAPLLRGLVRGVARRSVDVSAGAGGAESELRGRLAALTAAEQDRALLDLVRTQVAAVLGHAGPAAVESGRAFKELGFDSLTAVELRNRLNAATALRLPATLIFDYPDPTVLARYLRGELIGDDTTDAVAEPLTAVADDEPIAIVAMSCRYPGDVRTPEDLWQLLTAGADGITRLPENRGWDTEGLYDPDPESQGTSYARDGGFLHDAAEFDASFFGISPREALAMDPQQRLLLETTWEVFERAGIAPSAVRGSRTGVFAGVMYHDYGARLHAVPDGVEGYLGTGSSSSIVSGRVAYTFGLEGPAVTVDTACSSSLVALHLAAQALRNGECSLALAGGVTVMFTPGTFIEFSRQRGLAADGRCKSFAAAADGTGWGEGAGMLLLERLSDARRNGHQVLAVVRGSAVNQDGASNGLTAPNGPSQQRVIRQALANAGVAAGHVDAVEAHGTGTTLGDPIEAQALLATYGQEHTDDRPLLLGSVKSNLGHTQAASGVAGVIKMVMSMRHGVLPKTLHVDEPTPHVDWSAGAVSLLTEQTPWPETGRPRRAGVSSFGISGTNAHAIIEQAPEPDPARAKATARPAPDAAAPSSVPLIVSARGEDALRAQARRLHAHVHADPGLRAVDLGLSLATTRSALEQRAALVAGDRAELLRGLDALARGEDTAGLVRGTAREGQVAFLFTGQGSQRPGMGRELYDAHPVFADALDEICGELDRHLEVPLKGVLFATEGDLIHQTAYTQPALFAVEVALFRLLESRGVQPDFLAGHSIGEIAAAHVAGVFSLQDASELVAARGRLMQALPTGGVMIAVQASEDEVLPLLTDRVSIAAINGPQSVVIAGDEADAVAIAESFTDRKSKRLTVSHAFHSPHMDGMLADFRKVAEGLVYENPRIPVVSNLTGALVTDEMGSADFWVRHVREAVRFLDGIRALEAAGVTTHIELGPDGVLCAMAQECVSGEDTVFVPVLRPGRPEAETVTTALARVHVQGVPVDWQAYFSGTGAQRVDLPTYAFQRKRYWLDVGVSVEDVLAAGLDAADHPLLGATVSLPGSDGLVLTGRLALSTHPWLSDHTVMDTVLLPGTAFVELALRAGELVGCGAVEELALEAPLTLADQGAVQFQLAVDAPDGAGRRTLTLHSRRAGAPAEEPWTRHATGVLTPEASAVPAHPFDLTAWPPADAEPVPTDAFYPGAAAAGLGYGPVFQGLRAAWRRGDELFAEVALDEEHEADAAAYGLHPALLDAALHAIGLGAPGAPADAPAEGARLPFAWTGVRLYAAGAAGIRVRLTAAASGGIALDVADSTGAPVASVESLILRPVSAEQLGGDRTAHHESLFGVEWTRLSLPTGAIPSGERWAVLGEDEPDLRVGGERLDVYSGLTALREEIAAGTSAPDVVVVPLSSAASGGGRAGTARAAAHHALALVKEWLADERLDGARLVLLTRGAVAAVPDEHVTDLTHAPVWGLVRSAQSENPGRFVLADTDGADASFGALAAALATDEPQLALRSGEAHAFRLRRIARTASDPAGETGTGDGPTRADDAGRIAADGTVLVTGASGTLGGLFARHLATTHGARHLLLLSRRGDRAPGAGELTRELTEAGVDVTWAACDAADRDALAAVLAAIPADRPLTAVVHTAGVLDDGIIDSLTPERLDTVLRPKVDAAWNLHELTEGHELSAFVLFSSVAGCFGAAGQGNYAAANTFLDALAQHRKARGLTASSLAWGLWETTDGMAGALDEADLTRMARSGVAALAPDEGLALFDTSRTLDDAVLVPMRIELGALRAQAADGTLPPLLRGLVRTPARRAAGSTARAGTRPGTDPAGTLEERLAGLSAAERDRALMELVRTQVAAVLGYAGPDDVDAARGFLDLGFDSLTAVDLRNRLTASAGLRLPVTLIFDYPSPTALAAYLAERLGQGDPSRRPVHAELDKLESILSTVGPDDVERAGITARLRDLLAKWNETHSAQDSAADEREIQSATADEIFDLLDDELGLS

SEQ ID NO: 30 - DNA, 15624 bp, Streptomyces aizunensis
atggcgaatgaagagacgctgcgggactacctgaagctggtgacggcggatctgcaccagacgcgacagcgtctgcgcgacgtcgaggcgaagaatcaggaccccatcgcgatcgtcggcatgggctgccgctatcccggcggtgtgacctcgcccgaggagctgtggcagctcgtcgtggacggtggggacgccatttccggcttccccgccgaccgcggctgggacatggagacggtctaccacccggatcccgagcaccccggcacgagctacgccaaccagggtggcttcgtccgggacttcgcccggttcgacccgtcgctcttcggcatctcgccgcgcgaggccctcgccatggacccgcagcagcggttgctcctggagacctcgtgggaggcgttcgagcgggccgggatcgacccgacgtcgatgcggggcaagcaggtcggtgtcttcgtcggcaccagcaaccacgactacctgtcggcgctgctgagttcctcggagaacgtggagggctacctcggcaccggcaacgcggcgagcgtcgcctcgggccggctctcgtacaccttcggcctcgaaggcccggccgtcaccgtcgacacggcctgctcgtcgtcctcggtagccctgcacctggccgtgcaggcgctgcgcaacggcgagtgctcgctcgccctcgcgggcggtgccacgctgatgtcggctcccggcacgttcatcgactacagcaagcagcgcggactggccaccgacggacgctgcaaggcgttctcgcccgacgccgacggcttcagcctcgccgagggcgtgggcatcctgctggtcgagcggctctccgacgcccgccgcaagggacatcccgtcctggccgtggtccgtggcaccgccgtcaaccaggacggcgccagcaacggcctgaccgcgcccaacggcccgtcccagcagcgcgtcatccttcaggcgctgtccaacgccaggctcacccccgaccaggtcgacgcggtcgaggcccacggcacgggcaccggcctcggtgacccgatcgaggcgcaggcgctcatcgccacctacggccaggaccgccccgacgggcggccgctgtggctgggttcgctcaagaccaacatcggacacgcacaggccgcggccggtgtcgcgggcgtcatcaagagcgtcatggcgatgcgccacggcgtgctgccgcgcaccctgcacgtggacgagccgacccccgaggtcgactggtcggcgggtgacgtctccctgctcaccgaagcgcggccctggcccctgggcgaccagccgcgccggatcggcgtctcgtcgttcggcatgagcggcaccaacgcccacatcatcctggagagcgcgcaggagtacgccgacggccggcaggccgacgccggtaccgcggggaacgaaccggccaccggccgtacgaacccgcccggcgccctccccgtcgtcctgtccggccggaccgagcccgccctgcgcgcccaggccgccgcgctgcacgcccacctcgcggcccaccccggcctcggcatcgccgacctcgccttctcccaggccctcacccgcgcagcgctggaccggcgtgcggccgtcgtcgccgacgaccgcgacgccctgctggccgggctcgcggcactggcggaaggacgccccagcgcggacgtggtcgaaggcagcgccacggacggaaagctggcgttcctcttcaccgggcaggggagccagcggcccggcatgggccgtgagctgtacgcgacgtatcccgtcttcgcgcaggctctggacgcggtgtgcgagcggctcgaactgccgctcaaggacgtgctgttcgggaccgacggcgccgccggcgccgcgctcgacgagaccgcgtacacccagcccgcgctgttcgcggtcgaggtggccctcttccggctcgtggagagctggggcctgaagcccgactacctggccgggcactcgatcggtgagatcgcggccgcgcacgtggccggagtgttctcgctggaggacgcctgcaccctggtcgaggcgcgtggccgtctgatgcaggcgctgccgaccggcggcgtgatgatcgcggtcgaggcgtcggaggacgaggtcctgccgctgctcaccgactgggtgagcatcgccgccgtcaacggcccccggtcggtcgtcgtcgccggtgatgaggacgctgcggtcgcgatcgcggaggccttcgcagcccagggccgcaagaccaagaagctgacggtcagccacgccttccactcgccgcacatggacggcatgctcgacgccttccgcacggtcgcccagggactctcgtacgggactcctcgcatcccggtcgtctcgaacctcaccggcgccctcgtcaccgacgagatgggctcggccgacttctgggtccggcacgtccgcgaagccgtccgcttcctcgacgggatccgctggctggagagccgcggggtcaccacctacatcgaactcggccccggcggcgtcctgtccgccctcggccaggactgccagaccgcgaccggcccccgcgcggccgccttcctccccgcgctgcgcaccggccgccccgaggcgtcgtcgctgaccgcggccgtggccggcgcccatgtccgcgggctctccccggactggaccgtccgcttcgccggcaccggcgcacagcgcgtcgagctgcccacctacgccttccagcgcgagctgtactggccccgcgaccccttcaccgacccggccgaatccgcccacggcggcgaactcggcgccaccgacgccaagttctgggaggtcgtcgacagcgaggacctcgccgcgctcgccgacaccctcggggtcggcggcgacgaacccctcagcagcgtgctgcccgcgctctccgcctggcaccgccgccaccgcgaccgcgacaccgtggacggctggcgctaccgcgtcacctggaagccgctgacggacaccacgcccgcgtccccctccgggcactggctcctggtcgtccccaccgagcacgccgacgccccttgggccgtcgccgccgagcgggcactgaccgcacgcggtgtcaccgtgagcaccgtcgtgctcgacgcgaccctcgacgaccgggccgccaccgcccggcggatcggcgaagccctcgctgcctccgccgccaccgactccgccccggcgggcgccgaaacgctcgccggcgtgttctcgctgctcgccctggaggagcggccgcaccccgcggacccggcactgtccgccgggctcgccgccacggtcgccctcatccaggcactcggcgacgcgggagtggaagccccgctgtgggccgccacctgcggcgcggtctccaccggccgcaccgaccggctctccagcaccgcccaggcgcaggtgtggggcctcggccgcaccgccgccctcgaactgcccgtgcgctggggcggtctcgtcgacctgcccgggacccccgacgagcgggccgcgggccggctcgccgacgtcctcggcggactcggcggacccggcgccgaggatcacctcgccgtacgctccaccggcgtcttcgtccgcaggctggcccgcgccacccgcgacgagcgccccaccaccgagtgggccaccaccggcacggctctcatcaccggcggcacgggcgcactcggccgccacgtcgcccgctggctcgcccggaccggggcgcagcacctgctcctggtcagcaggcgcggcccggaagccgagggagccgacgcgctcgccgccgaactgcgcgcactgggcgccgaggtcaccatcgccgcctgcgacgtcgccgaccgcgacgccgtcgcggccctgctcgccaccctcccggccgagcacccgctgaccaacgtcgtgcacgccgccggggtgctcgacgacggcgtcctggacgcccagaccccgcagcgcctcgcgggggtcctgcgccccaaggcccacgcggcgcaggtcctgcacgagctgacccgcgacctggacctctccgccttcgtcctcttctcgtccgtcgccgccgtcttcggcgccgccggtcaggccaactacgctgccgcgaacgcctccttggaggccctcgccgagcagcgccgcgccgacggcctgcccgccaccgtgctggcctggggcgcctgggccgaaggcggcatggccaccgacgaactcgtcgccgagcgcctgcggctggccggactgcccgccctcgcacccgaactcgccctgtccgcactgcacagggcgctcaccctggacgagaccgcctcgctcgtcgccgacatcgactgggagcgcctggcccccggcctcaccgccgtacgcccctgcccgctgatcgccgacctccccgaggccgtgcacgccctcgccggagccgaggcgtccaccgggcccggcgccgccgccgacacgttcgcgcggcagctggccgacgcccccgccggtgaacgcgaccagctcgccctggagttcgtacgcacccaggtcgcggccgtactcggttacgccggtcccgagtccgtcgacccgggcagcgccttccgggacctcggcttcgactcgctcaccgcggtggagatccgcaacctcctcacctcccggaccggcctgcgcctcccggcgacgctgatcttcgactaccccaactccctctccctggccgccttcctgcagggagaactgctcggcgcgcaggcgaccgaccccgcccgccacacccccgcgggccccggcaccgccaccgatgacgaccccatcgcgatcgtcgcgatgagctgccgcttccccggcggcgtacagagcccggaagacctctggcagctgctctccaccggccgtgacgcgatctcgggcttccccggcgaccgcggctgggacctcgacgggctgtacgaccccgagtccgccggggagaacaccagttacgtccgcgagggcggcttcctcgccggtgccaccgagttcgaccccgcgttcttcgggatctccccgcgcgaggccctcgccatggacccgcagcagcgcctgctgctcgaaacctcgtgggaggccttcgagcgcgccggaatcgaccccgccaccgtgcgcggcgaacagatcggcgtcttcaccggcaccaacggccaggactacctcaacgtcatcctggccgcacccgacggtgtcgaggggttcctgggcacgggcaacgcggcgagcgtggtctccggccgcgtctcctacgtcctcggcctggagggcccggccgtcacggtcgacacggcctgctcgtcctcgctggtcgccctgcactgggcgatccaggccctgcgccagggcgagtgcaccatggccctggccggcggcgtgaccgtcatgtccacgcccgcctccttcatcgacttcagccgtcagcgcggcctcgcggaagacggccgtatcaaggcgttcgccgcggccgcggacggtacgggctggggcgagggcgtcggcatcctcctcgtcgagaggctctccgacgcacagcgcaacggccatccggtcctggcgatcgtgcgcggctcggccatcaaccaggacggcgccagcaacggcctcacggcgcccaacggcccgtcccagcagcgcgtcatccgccaggccctcgccagcggcggactgacgacgatggacgtcgacgccgtcgaggcccacggcacgggtacgaagctcggcgacccgatcgaggcgcaggcactcctcgccacctacgggcaggaccggccggaaggccgtccgctgctcctcggctcgatcaagtcgaacctcgggcacacgcaggccgccgccggtgtcgccggtgtcatgaagatggtcctcgccatgcagcacggtgtgctgccgcagaccctgcacgtcgacgagccgaccccgcacgtggactggtcggcgggcgacgtcgccctgctggccgatgccgtggcgtggcccgagaccgggcgtccgcgccgggcgggcgtctcgtcgttcggcatcagcggcaccaacgcccacaccatcatcgaacaggccccggcagccgtggcgcccgtcccgcccgtcgccaccacgcccgcacgggccgacggaccgcagccgtggctcctctcggcgaagacccgcgacgcactccacgaccaggcgcgccgactgcacgcccacgcggagctgaacccggaactgagccccgccgacctcggactctccctggcggccggccgttcggcgttcgagcggcgcgcggccgtgatcgccgcagaccgtgacgggctgctggccggcctcgcggccctggcggacggcggcgcggcggcaggactggtggagggctcaccggtcgccggaaagctggcgttcctgttcaccgggcaggggagtcagcggctcgggatgggccgtgagctgtacgacacgtaccccgtcttcgcggacgcgctcgacgcggtctgcgcgcatgtggacgcgcacctcgaagtcccgctgaaggacgtcctgttcggggcggatacgggtctgctggaccagacggcttacacgcagcccgcgttgttcgcggttgaggtggcgttgttccggctggtggagagctggggtctgaggcccgacttcctggccggtcattcgatcggtgagatcgcggccgcgcatgtggcgggcgtcttctcgcttcaggacgccagcgaactggtcgtcgcccgtgggcggttgatgcaggcgctgccgaccggtggcgtgatgatcgccgtccaggcgtcggaggacgaagtcctgccgctgctgaccgaccgggtgagcattgccgcgatcaacggccctcagtcggtcgtcatcgcgggtgacgaggccgacgcggtcgcgatcgcggagtcgttcacggggcgcaagtccaagcgcctcacggtcagccacgcgttccattcgccgcacatggacggcatgctggaagacttccgggccgtggcggagggcctctcgtacgaggctccgcgcatccccgtcgtctcgaacctcaccggcgctctgatctcggacgagatgggctcggccgagttctgggtccggcacgtccgtgaggccgtccgcttcctcgacggcatccgcacgctggaagccgcaggcgtcaccaagtacgtcgaactcggccccgacggcgtcctgtcagccatggcccaggactgcgtgagcggcgagggctccgtcttcatccccgtactccgcaaggcgcgccccgagcccgagagcgtcaccaccgccctcaccacggcccacgtccacggcatccccgtcgactggcaggcgttcttcgccgggaccggcgcccggcgcgtcgacctccccacctacgccttccagcgccagcgctactggcccgccgtctcctccctctacctcggcgacgtcgaggcgatcgggctcgacgacaccgcgcacccgctgctcagtgcgggtgtcgccctgcccgagtccgacggcatggtgttcgccgggcggctcgcgctctccacccacgcctggctcgccgaccacgccatcctcggcagcgtcctgctgcccggtacggccttcgtcgagctggccacccgcgccggcgaccaggtcggctgcgattacctggaagagctgaccctcgaagcgcccctcgtcctgcccgagcacggcggcgtccagctgcgcgtgtgggtcggcgccgccgacgagtccggccgacggccgttcgccctgcactcccgggccgaaggcctgccggtcgaggagccgtggacgcggcacgccggcggtgtactcgccgaaggcgggcggcccccggccgacttcgacctgacggcctggcccccgccgggcgccgtcgaagtggaccttgacgggcgctacgaccagctcgacggcatcggcttcgcctatggccccaccttccgtggcctgcgtacggcctggcagctcgacggcgagatctacgccgaggtcaggctgcccgagggagccgagggcgaggcgggccggttcggcctgcacccggccctgctcgacgcggcactgcacgccatcgggctgggcggcctcggcgccgacgacggccaggggaggctccccttcgcctggagcggagtatcgctgcacgcgggcggggctgccgcactgcgcgtccacctcgctccggcgggcgccgagggcgtccgcctggagatcgcggacgcctcgggcgcaccggtcgcggccgtcgagtcgctcgggctgcgcccggtgacggccgagcagctccgtgccgctcgtgccacctaccacgagtccgtgttccgtcagcagtggaccgagctgccgggtctcggcgctccggccgcgacccccgccgtccggtacgcgttcctcggcggcgacagcggcgacagcggcgacagcggtgacaccgcagccgccgaccgtcaccaggacctggcggcgctcgccgccgcgatcgacgccggaaggcccgtaccggacgaggtggtcgtcgaactcgccgccgcgccctgggccgtgtcggcgtcggccgtgcacagtgccgcgcacgatgcgctggcactcatccagacctggctcgcggacgaccggttcgccgccgcacgcctggtgttcctcacccgcggcgcggtggccgcggacgcgggcgacgacgtgaccgatctcgccgccgccaccgtgtggggcctgctgcggtccgcgcagacggagaaccccggcaggatcgccctcgtcgacaccgacggccacgaccggagcgagcaggccctgcgggcggcgctcacctccgacgaggagcggttcgcgctgcgcgccggagcggtcctcgtgccccggctcgcccgggtcgagatccagcaggacgactccgcccggacaccggccctcacgcccggcggcacggtactgatcaccggagccaccggagcgctgggcggtctcttcgcccggcacctcgccgccgaacacggcgtggagcggctgctcctcgtcggcaggcgcggggccgacgcccccggcgcggccgaactcgtcgccgaactcgccgagtcgggcaccctcgccacctgggcggcgtgcgacgtggccgaccgggacgcgctcgcggcactgctcgcggacattcccgccgagcacccgctgaccgccgtcgtccacacggccggagtcctcgacgacggcgtcatctcctcgctgacgcccgagcggctctccgccgtgctgcggcccaaggtggacgcggcctggaacctgcacgagctgacccggggcctcgacctcgccgccttcgtgctcttctcctccacctccggcctcttcggcggccccggacagggcaactacgccgccgccaactccttcctggacgccctcgcccagcaccgccgcgctcacgggctccccgcgacctcgacggcctggggcctgtggtccgtggccgacggcatggcgggcgccctggacgcggccgacgtcaaccgcatgcggcgggccggactgccgccgctgaccgccgccgacggcctcggcctgttcgacacggcggtctccctcgacgaggcctccctggccctgatgcgggtggacaccgaagtcctgcgcacccaggccggggccggtaccatcgcgccgctgctgcgcggtctcgtacggggcgtggcccgccggtcggtcgacgtgtcggccggtgccgggggcgccgaatcggagctgcgcggcaggctggcggcgctcaccgccgccgagcaggaccgggcgctgctggacctggtgcgtacgcaggtcgcggcggtcctcggacacgccggacccgcggccgtggagtcgggacgggccttcaaggaactcggtttcgactcgctcaccgcggtggagctgcgcaaccggctgaacgccgccaccgcgctgcgcctgcccgcgacgctgatcttcgactatccggacccgaccgttctcgcccggtacctgcgcggcgagctgatcggtgacgacaccacggacgccgtggccgagccgctcacggccgtggccgacgacgagcccatcgccatcgtcgccatgagctgccgctaccccggtgacgtacgcacccccgaggacctgtggcagctgctgacggcgggcgccgacggcatcacccggctccccgagaaccggggctgggacaccgagggcctgtacgacccggacccggagagccagggcacctcgtacgcccgcgacggcggattcctgcacgacgcggccgagttcgacgcctccttcttcgggatctcgccgcgcgaggccctcgccatggacccgcagcagcgcctcctcctggagacgacctgggaggtcttcgaacgggccggcatcgcgccgtccgcggtgcgcggcagccggacgggtgtcttcgcgggtgtcatgtaccacgactacggcgcgcgcctgcacgccgtgcccgacggcgtcgagggctacctcggcaccggcagctccagcagcatcgtgtcgggccgggtcgcctacaccttcggcctggagggcccggcggtcaccgtcgacacggcctgctcctcgtcgctggtcgccctgcacctcgcggcccaggcgctgcgcaacggcgagtgctcgctcgctctcgcgggcggtgtcaccgtgatgttcacgcccggaaccttcatcgagttcagccgtcagcgcggcctggccgccgacggacgctgcaagtccttcgcggccgccgccgacggcacgggctggggcgagggcgcgggcatgctcctgctggagcggctctccgacgcgcgacgcaacggccaccaggtcctcgcggtcgtccgcggctcggccgtcaaccaggacggcgccagcaacggcctcaccgccccgaacggcccctcgcagcagcgcgtcatccggcaggccctcgccaacgccggtgtcgccgccggacacgtcgacgccgtcgaggcacacggcaccggcaccaccctcggtgaccccatcgaggcgcaggccctgctcgcgacctacggccaggagcacaccgacgaccggccgctgctcctcggctcggtgaagtccaacctcggtcacacacaggccgcttcgggcgtcgccggtgtcatcaagatggtcatgtcgatgcggcacggtgtgctgccgaagaccctgcacgtcgacgagccgaccccgcacgtggactggtcggcgggcgcggtctcgctcctcaccgagcagaccccgtggcccgagaccggccgtccgcgccgcgcgggcgtctcctccttcggcatcagcggcaccaacgcgcacgccatcatcgagcaggccccggagccggacccggcccgggcgaaggcgacggcgcggcccgcgccggacgccgcggcgccgtcgtccgtgcccctgatcgtgtccgcccgcggcgaggacgcgctgcgcgcccaggcccgcaggctccacgcccacgtccacgccgaccccggcctgcgcgccgtcgacctcggcctctccctggcgaccacccgctcggccctggagcagcgcgcggcgctggtggccggcgaccgcgcggaactgctgcgcggcctggacgccctggcccgcggcgaggacaccgcggggctggtgcgcggcaccgcccgcgagggccaggtggcgttcctgttcaccggtcagggcagccagcggccggggatgggacgcgagctgtacgacgcgcatcccgtcttcgcggacgcgctcgacgagatctgcggcgaactggaccggcacctcgaagtaccgctcaagggcgtgctgttcgcgaccgagggcgatctgatccaccagaccgcgtacacgcagcccgcgctgttcgccgtggaggtggccctgttccggctcctggagagccggggcgtgcagcccgacttcctggccggtcactcgatcggtgagatcgccgcagcccatgtggcgggcgtcttctcgctccaggacgccagtgaactggtcgccgcccgtgggcggttgatgcaggcgctgccgaccggtggcgtgatgatcgccgtccaggcatcggaggacgaggtcctgccgctgctgacggaccgggtgagcatcgccgcgatcaacggcccccagtcggtcgtgatcgcgggcgacgaggccgacgcggtggccatcgccgagtccttcacggaccgcaagtccaagcggctcacggtcagtcacgccttccactcgccgcacatggacggcatgctcgccgacttccgcaaggtcgccgagggcctcgtctacgagaacccgcgcatcccggtcgtctcgaacctcacgggggccctggtcaccgacgagatgggttcggccgacttctgggtccggcacgtccgcgaggccgtccgcttcctcgacggcatccgcgccctggaagccgcgggcgtcaccacacacatcgagctgggccccgacggcgtgctctgcgccatggcccaggaatgcgtgagcggcgaggacaccgtcttcgtccccgtactgcgccccggccgccccgaggccgagaccgtcaccaccgccctcgcccgcgtccacgtccagggcgtacccgtggactggcaggcgtacttctccggcaccggcgcccagcgcgtcgacctgcccacctacgccttccagcgcaagcgctactggctcgacgtcggcgtctccgtcgaggacgtgctggcggccggtctcgatgcggccgaccaccccctgctgggcgccaccgtctccctgcccggatccgacgggctggtcctcaccggacgcctcgcgctgtccacgcacccctggctgagcgaccacaccgtcatggacaccgtcctgctgcccggcacggccttcgtcgaactcgccctgcgggccggtgaactggtcggctgcggcgccgtcgaagagctggcgctcgaagccccgctcaccctcgccgaccagggcgccgtccagttccagctggccgtggacgcgccggacggcgccgggcgccggaccctgaccctgcactcccgccgcgcgggtgccccggccgaagagccgtggacacggcacgccaccggcgttctcacgcccgaagcgtccgccgtgcccgcgcaccccttcgacctgaccgcatggccgccggccgacgcggagcccgtgcccaccgacgccttctaccccggcgcggccgcggccggcctcggctacggaccggtcttccaggggctgcgggccgcctggcggcgcggcgacgaactgttcgccgaggtcgcactcgacgaggagcacgaggccgacgccgccgcctacgggctgcaccccgccctgctcgacgcggccctgcacgccatcggcctcggagcgcccggcgcgcccgccgacgccccggccgaaggagcccggctgcccttcgcctggaccggcgtacgcctgtacgcggccggcgcggcgggcatccgcgtccggctgaccgccgccgcatccggcggcatcgccctggacgtggccgactccaccggagcgccggtggcctccgtcgagtccctgatcctgcgccccgtctccgcggagcagctcggcggggaccgcacggcccaccacgagtcgctcttcggcgtcgagtggaccaggctgtccctccccaccggtgcgatcccctccggcgaacgctgggccgtactcggcgaggacgagccggacctccgggtcggcggcgaacgcctcgacgtgtacagcggtctcacggcgctgcgcgaggaaatcgccgcgggcacctcggcgccggacgtcgtcgtcgtacccctgtcctccgccgcgtccggtggcggacgtgcggggaccgcccgggccgccgcgcaccacgcgctggccctggtcaaggagtggctggccgacgaacggctcgacggcgcacggctcgtgctgctgacccggggcgcggtggccgccgtacccgacgagcacgtgaccgatctgacccacgccccggtgtggggcctcgtacggtccgcgcagtcggagaaccccggccggttcgtgctcgccgacaccgacggcgccgacgcctccttcggggcgctggccgccgcgctcgccaccgacgagccgcagctcgccctgcggtccggcgaggcacacgccttccggctgcgccgcatcgcccgtaccgcgagcgatccggccggtgaaaccggcacgggcgacggccccacccgtgccgacgacgccgggaggatcgccgccgacggcacggtcctggtcaccggcgcgagcggcaccctcggcgggctcttcgcccgccacctggccaccacgcacggcgcacggcacctgctgctgctgagccgtcgcggggaccgggcccccggggccggggaactgacccgtgagctgaccgaagcgggcgtggacgtgacctgggcggcgtgcgacgcggccgaccgggacgcgctcgccgccgtactcgccgcgatcccggccgaccggccgctgacggcggtcgtccacaccgccggtgtgctcgacgacggcatcatcgactccctcacacccgaacgcctcgacaccgtgctgcggcccaaggtcgacgcggcctggaacctgcacgagctgaccgagggccacgaactctccgccttcgtgctcttctcctcggtcgccggctgcttcggcgccgcgggccagggcaactacgcggcggccaacaccttcctggacgccctcgcccagcaccgcaaggcccggggcctcaccgccagttccctcgcctggggcctgtgggagacgacggacggcatggccggcgcgctcgacgaagccgacctgacccgcatggcccgctccggtgtggccgcgctcgcccccgacgagggcctggccctcttcgacacctcccgcaccctggacgacgcggtcctcgtccccatgcggatcgaactgggcgcgctgcgcgcccaggccgcggacggcaccctgccgccgctgctgcgcggactggtgcgcactcccgcgcgccgggccgccggctccacggcacgcgccggaacgcgccccggcaccgacccggcgggcaccctcgaagagcgcctcgccggactgtcggccgccgaacgcgaccgggccctcatggagctggtccgcacacaggtggccgcggtcctgggctacgcgggccccgacgacgtcgacgccgcacggggcttcctcgacctgggcttcgactcgctcacggccgtcgacctgcgcaaccgcctcacggcgagcgccggactccggctgcccgtcacgctcatcttcgactacccgtctccgaccgcgctcgccgcgtacctcgccgaacgcctcggccagggcgacccgtcccgccggcccgtccacgcggaactcgacaagctcgaatcgatcctctcgacggtcggccccgacgacgtcgaacgcgcgggcatcaccgcccggctgcgagaccttctggcgaagtggaatgaaacgcacagtgcacaggacagcgccgcagacgagcgggaaatccagtccgcgacggccgacgagatcttcgatctcctcgacgacgaactcgggctgtcctga

SEQ ID NO: 31 - protein, 5432 aa, Streptomyces aizunensis
MVNEEKYLDYLKRATTDLREARRRLREVEEREQEPIAVVAMSCRYPGGIDTPEKLWDLVAHGRDAVSAYPTDRGWDAEVLFDPDPETGIEAYEQVGGFLHDAADFDPAFFGISPREALAMDPQQRLLLETSWEAFERAGIDPATLRGSRTGVFAGLMYHDYAARLFSVPEEIEGFLGNGSSGSIASGRIAYTLGLEGPAVTVDTACSSSLVAVHLAAQALRNGECTLALAGGVTVMSTPGTFTEFSRQRGLAADGRCKSFAAAADGTGWGEGAGMLVLERLSEARRNGHPVLALVRGSAVNQDGASSGLTAPNGPSQQRVIRQALAGARLSATQVDAVEAHGTGTTLGDPIEAQALLATYGQDRPDGRPLWLGSIKSNMGHTQAAAGIAGIIKMVMAMRHGILPKTLHVDEPTPNVDWSEGAVSLLTESVPWPETGAPRRAGVSSFGISGTNAHTILEQAPDAVEAAPGTEPPAAAAPPVPPLWTLSAKSPAALRAQAGKLHAHLTAHPGLRPGDIAHSLAVGRTDFEHRAVLTSADGPVGLVRALEALADSAPEDTAPADRAPGVTRGRPVAGKLAFLFTGQGSQRLGMGRELYETYPVFAQALDAVCERLNLEVPLRDVLFGADAGLLDQTVYTQTALFAVEVALFRLVESWGLKPDFLAGHSIGEIAAAHVAGVFSLEDACALVSARGRLMGALPGGGVMIAVQASEDEVLPLLTDRVSIAAINGPQSVVIAGDEADAVAIAESFADRKSKRLTVSHAFHSPHMDAMLEDFRAVAEGLSYEAPRIPVVSNLTGALVSDEMGSADFWVRHVRETVRFLDGIRALTERNVVHFVELGPDAVLSAMAQDCPSADTAAFVPVLRKGRSETGSLTDALARLHVGGVAVDWDAYYSGTDVQRVDLPTYAFQRAHYWLDAGRPLGDVSSAGLGAAGHPLLGAAVALADLDGFLYTGRLSLDTHPWLADHAVMGSAVLPGTAFVELAIRAGDQVGCDLLEELTLHAPLVLPPAGGVQVQLWVGAPDATGRRTLGVHSRPEPAPDAVGPDADAAEPWTRHADGVLATGAPQPSFAPDVWPPAGARPLPVDELYAGLAEAGLEYGPAFQGVRAAWASDDAAYVEIAAADGQWADAPLFGLHPALLDSALHAIGLAGLVEDTGRGRLPFSWSGVSLYAVGASVLRVRLAKAGPDAVSLALADGAGQPVGDIASLTLRPVSAEQLDTGRGGHHDALFQVDWTPLNLPRAVDSRWAVLGEPVPTDEPGDGVARHADAEALSAALDAGAPVPDAVLVRHPALPEPTPEAVHQAAHRTLGLLRHWLGDDRLADSRLVLLTHGAVAAGDADQVPDPVHAVVWGLVRSAQSEHPGRFLLIDSDSGIDTLSWPTFGAVLASEEPQVALRGGVAHAPRLAKVPATATAAAVVETSSYDPDGTVLVTGASGTLGGLVARHLVTGRGVRRLLLLSRRGADAPGAGELAAELTGLGAEVSWAACDAGDRDALAAVLAAVPAAHPLTAVVHTAGVLDDGVIGSLTPERLDTVLRPKADAALHLHELTRDLPLTAFVLFSSAAGVFGAPGQGNYAAANSFLDALAQYRRAHGLPGRSLAWGLWEDAEGMAGALDRADLDRMKRGGVHGLTASEGLALLDLADALGADRDDQGQDQETAGRALLVPMRLTLPAVAPGAEVAPLFRGLVRTPARRVAAGATTGATTGTGPDLSALERRLLGLDAPERERLLLDLVRGHVADVLGHGSPDAIDPEQAFSELGFDSLTAVELRNRLGAAIGRRLPATLIFDHPASLTLARHLSGELAGSQAALAPAGPAPTVTDDDPIAIVAMSCRYPGGVTTPEELWQLLAGGGDAISGFPADRGWDVESLYDPDPDHPGTSYTRHGGFLRDAAAFDPTFFGISPREAVGTDPQQRLLLETTWEAFERAGIDPATVRGSRTGVFAGVMYHDYAALLERSKDGADGSLGSGSTGSIASGRVSYTFGLEGPAVTIDTACSSSLVALHMAIQALRTGECDMALAGGVTVMATPGTFIGFSRQRGLSADGRCRAFSADADGTGWGEGVGMLLVERLSDARRNGHPVLAVVRGSAINQDGASNGLTAPNGPSQQRVIRAALASAGLSAAEVDAVEAHGTGTTLGDPIEAQALLATYGREHTEDSPLWLGSIKSNMGHTQAAAGVAGVIKMVLAIQHGVLPRTLHADRPSPHVDWSQGAVSLLTESVPWPETGRPRRAGVSSFGISGTNAHTIIEQAPEEATVAPADAVAAPSALPLQLAGRSAEALSAQARALSAHLTAHPDVPLADLAYSLATSRATFDHRAVLVATEGTTAATAVTALDALADRRTAPGLVRGTASKGGRTAFLFTGQGSQRLGMGRELYEAHPVFARALDAVCDRLELPLKDVLFGTDAGLLNETVYTQPGLFAVEVALFRLLESWGVKPDFLAGHSIGEIAAAHVAGVLSLDDVCALVEARGRLMGALPGGGVMIAVQASEAEVLPLLTDRVSIAAINGPRSVVIAGDEADAVAIVESFTDRKSKRLTVSHAFHSPHMDGMLDAFREIAEGLSYEAPRIPVVSNLTGALVSDEMGSADFWVRHVREAVRFLDGIHALEAAGVTTYVELGPDGVLSAMAQECVTGEDSVFVPVLRSGRPEAESVTTALAQAHVRGIAVDWQAYFAGTSAQRVDLPTYRFQREHYWPETGIPLPGDTAGLGLAAAGHPLLGAAVTLADADGCVLTGRLSLRTHPWLADHAVMGSVLLPGTALVELALHAGERVGTRALDELTLQAPLILPNEGAVQLQVVVGAPDAAGHRTVAVYSRPDADGEAWVRHADGLLVDEVRGAAADLGVWPPAGATAVPVDDAYAILETSGLAYGPLFQGLRAAWRRAGELFAELALPTEAQADAAAFGLHPALLDSALHTLALGDLLSGADAEETPGAARLPFAWRGVRLHAAGAPAVRVRLAEAGQGAVSLELADSAGAPVASVDSLVLRAMSPEQLGAASAGRQESLFQIDWVEPAADRTAAATDVERALVGPELRGLDATPYADLAALAAADSDVPELVFITTRAESEPEGLPGTVHVRAVDALTHVRAWLAEERFASARLVFVTRGAMTVGSDEAVRDLAGAAVWGLVRSAGTEHPGRFALVDLDDDDVLPEQTVLTALAAGESELVVREGSLLVPRLARAAVVEGSGRELDVDGTVLVTGASGTLGGLFARHLVVERGVRRLLLVSRRGGAAEGAAELGAELTELGADVRWAACDVADREALESVLAGIPAEYPLSGVVHTAGVLDDGVVSSLTAERVSAVLRPKVDAAWNLHELTRGLDLSLFVLFSSAAGVFGGAGQANYAAANVFLDALAQHRRAQGLAATSLAWGLWAEPGGMAGALDADDVSRLGRGGVSGLSAGEGVALFDAASASEQALFVPVKLDLAALRAQAGSGMLPPLLSGLVRTPTRRAAGTANAAVSAPGDRLAGLSAAEQVAHVLELVRTQVAAVLGYASPEAVEKDSSFRELGFDSLTAVELRNLLGAATGLRLPATLVFDYPTSAVLADHLRSELVGTAPVTSAPVVLAARDDDEPIAIVGLGCRYPGGVESPDDLWRLVLEGRDAITEFPEDRGWDVDALFDADPDQQGTSYAREGGFVRDAGHFDPAFFGISPREAVAMDPQQRLLLETSWEAFERAGIDPAALRGSRTGVFAGVMYHDYASRLTALPEGVEGFLGTGNAASVISGRLSYAFGLEGPAITVDTACSSSLVALHLAVQALRNGECSLALAGGVTVMATPAAFVEFSRQRGLAADGRCKAFSAGADGTGWSEGAGVLLVERLSDARRNGHPVLAVVRGSAINQDGASNGLTAPNGPSQQRVIRQALASAGLSAADVDVVEAHGTGTTLGDPIEAQALLATYGQEHTDEQPLLLGSIKSNFGHTQAAAGVAGIIKIVQAMRHGVVPKTLHVDEPTPHVDWSAGAVSLLTEQVAWPETGRPRRAAISSFGFSGTNAHAIIEQAPDPAPEDLPDAGPDVRPEPARTPGSLPWLLSAKGADALRDQAARLRAHAIGHPELSLADIGYALATSRTALDRRAAVVAGDREEFLAGLAALAEGATAAGLTEGSPAGGKLAFLFTGQGSQRLAMGRELYSAHPVFARALDAVCDGLALDVPLKQVLFGSDADLLDRTAYTQPALFAVEVALFRLVESWGLKPDFLAGHSIGEITAAHVAGVLSLDDACTLVAARGRLMQALPTGGVMIAVEASEDEVLPLLTDRVSIAAINGPQSVVIAGDEADAVAIAESFTGRKSKRLTVSHAFHSPHMDGMLDAFREVAEGLSYGTPLIPVVSHLTGTLVTDEMRSPDFWVRHVREAVRFLDGIRTLEDAGVTTYIELGPGGVLSAMGQSCVTRDDAAFLPALRADRSEEETLTSAVARAHLRGITVDWDAYYSGTGARRVDLPTYAFQRQRYWLEAPAHAPGGDVTSAGLGSAGHPLLGAAVELPDSDGFLFTGRLSLRTHPWLGDHRVAGTVLLPGAALLELAVRAGDHAGCDLLEDLTLEAPLVLPEAGGVQLRLVVAEPDASRRRVFHIYSRPEDAAFEEPWTRHAGGVLAVEGAHPAEAESEWPPAGAVPCPVEDLYPSLDAIGLGYGPAFRNLLLAWKRGDEVFAEVALGEDRRTEGALYGLHPALLDAALHAVGLGDFFPDGPEGARLPFSWDGVRLHAVGAAALRVRMAPAGQDAVTLAVSDETGRPVLTVDSLVLRPLALDGPGGLGGAGRGPGSVRDALFQVDWHALPLPEAQSPAEGRWALLGGDPLKLAAALERTGVLEPGALFGTASEDTGGHPRDLSALADAVELAEALGEPAPETVLVSLAPDLAATGGLASAAHRAAADALELIQAWLADERLAGSRLALVTRGAVATDPDADVDDLAHAAVWGLVRSAQAEHPGRLVLVDLDDEDDSYRALPAALDTDETQLAVRDGAVLAPRLARAVIAPATDAAAPDVAPDPEGTVLITGASGTLGGLLARHLVTEHGVRHLLLTSRRGAAAEGATQLADELVTLGAQVTWAACDAADRDALAALLESVPAAHPLTAVVHTAGVLDDGTVESLTAGRMATVLRPKVDAAWNLHELTHGLDLAAFVLFSSAAGVFGNAGQANYAAGNTFLDALAQHRRAQGLTAVSLAWGLWDDEAGMAATLDEQDRRRLSRGSMNPLSVAEGLALFDAALPGGASSGAVPEGARTASVLVPARLDLAVLQAQVGDLVPPLLRGLLRTPVRRRASGAAADAPDSLAQRLAQLPPAERDRVLLDLVCTQVAQVLGHSGAAAIEPGSAFKELGFDSLTAVELRNRLGAVTGLRLPATLIFDYPTPEALSGHLRSALPLDEDGPSVFSELDRLESALGAADADSVTRSRITMRLQALMTKWNDAQDANGGAPDEDADDGALETATDDELFDLLDNELGAS

SEQ ID NO: 32 - DNA, 16299 bp, Streptomyces aizunensis
atggtgaacgaggagaagtacctcgattacctcaagcgggcgactaccgacctccgcgaggcacgacgacggctgcgcgaggtggaggaacgggagcaggagccgatcgccgtcgtggcgatgagctgccgctaccccggggggatcgacacccccgagaagctgtgggacctcgtcgcccacggccgggacgccgtctccgcctaccccacggaccgcggctgggacgccgaagtcctcttcgaccccgaccccgagaccgggatcgaggcgtacgaacaggtcggcggcttcctgcacgacgcggccgacttcgaccccgcgttcttcgggatctcgccgcgcgaagccctcgccatggacccccagcagcggctgctgctggaaacctcctgggaggcgttcgagcgggccggaatcgacccggcgaccctgcgcggcagccgtacgggcgtcttcgccggcctgatgtaccacgactacgccgcccggctgttcagcgtgcccgaggagatcgagggcttcctcggcaacggcagctccggcagcatcgcctcgggccggatcgcctacaccctcggcctcgaaggccccgccgtcaccgtcgacacggcctgctcctcctcactggtcgccgtgcacctcgcggcccaggcactgcgcaacggcgagtgcacgctcgccctcgccggtggtgtcaccgtcatgtcgacccccggcaccttcaccgagttcagccgccagcgcggcctggcggccgacggccgctgcaagtccttcgcggccgcggcggacggtacgggctggggcgaaggcgccggcatgctcgtcctggaacggctctccgaagcccgcaggaacggccaccccgtcctggcactcgtgcgcggttcggccgtcaaccaggacggcgccagcagcggtctgacggcccccaacgggccgtcccagcagcgcgtcatccgccaggcactcgccggtgcgcggctgtcggccacccaggtcgacgcggtcgaggcccacggcaccggcaccaccctcggcgacccgatcgaagcgcaggccctgctcgccacctacggccaggaccgtcccgacggccgcccgctgtggctgggctccatcaaatcgaacatgggtcacacccaggccgccgccggtatcgcgggcattatcaagatggtcatggcgatgcgccacggcatcctccccaagaccctgcacgtcgacgagccgaccccgaacgtcgactggtccgagggcgcggtctccctgctcaccgagtccgtgccgtggcccgagaccggcgcgccccgccgcgcgggagtctcgtcgttcggcatcagcggcaccaacgcccacaccatcctcgaacaggccccggacgccgtcgaggccgcacccgggaccgagccccccgcggcggccgcaccgcccgtgcccccgctctggaccctctccgccaagagcccggccgcgctgcgcgcccaggccgggaaactgcacgcccacctgaccgcacaccccggcctgcgccccggggacatcgcccactcgctcgccgtcggacgcaccgacttcgagcaccgcgccgtcctcacctccgccgacgggcccgtgggcctcgtccgtgcgctggaagccctcgcggactcggctcccgaggacacggcacccgccgacagggcaccgggggtcacccggggccgcccggtcgccgggaagctggcgttcctgttcaccgggcaggggagccagcggctggggatgggccgcgagctgtacgagacgtatcccgtcttcgcgcaggctttggacgcggtgtgtgagcggctgaatctcgaagtgccgctgagggatgtcctgttcggggcggatgcgggtctgctggaccagacggtctacacgcagaccgcgttgttcgcggtcgaggtggcgttgttccggctggtggagagctggggtctgaagcccgacttcctggcgggtcattcgatcggtgagatcgcggccgcgcatgtggcgggggtgttctcgctggaggatgcgtgcgcgctggtgtcggcgcgtggccgcttgatgggtgcgctgccgggtggcggcgtgatgatcgccgtccaggcgtcggaggacgaggtcctgccgctgctcaccgaccgcgtgagcattgccgcgatcaacggtccgcagtcggtcgtgatcgcgggcgacgaggccgacgcggtggcgatcgccgagtccttcgcggaccgcaagtccaagcggctcacggtcagtcacgccttccattcgccgcacatggacgccatgctggaggacttccgggccgtggcggagggcctgtcgtacgaggccccgcgcatccccgtcgtctccaacctcaccggcgccctcgtctccgacgagatgggctcggccgacttctgggtccgccacgtccgcgagaccgtccgcttcctcgacggcatccgcgccctcaccgagcgcaacgtcgtccacttcgtcgaactcggcccggacgccgtgctgtcggccatggcccaggactgcccctccgccgacaccgcggccttcgtgcccgtactccgcaagggccgttcggagaccggttcgctgaccgacgccctcgcgcggctccatgtgggcggggtggccgtcgactgggacgcgtactactccggtacggacgtccagcgcgtcgacctgcccacctacgccttccagcgcgcgcactactggctcgacgcaggccggcccctcggcgacgtctcctcggccgggctcggtgcggccggccacccgctgctcggggccgccgtggccctcgccgacctcgacggtttcctctacaccggccgtctctcgctcgacacccacccctggctcgccgaccacgccgtcatgggttcggccgtactgccgggcaccgccttcgtcgaactggccatccgcgccggtgaccaggtcggctgcgacctgctcgaagaactcaccctgcacgcaccgctcgtactgcccccggccggaggtgtgcaggtccagttgtgggtcggcgcaccggacgccaccggccgccgcaccctgggtgtgcactcccgccccgagcccgcaccggacgccgtcggcccggacgccgacgcggcggagccgtggacccggcacgccgacggtgtgctcgccacgggtgccccgcagccgtccttcgcccccgacgtctggccgccggccggtgccaggcccctgcccgtcgacgagctgtacgccgggctcgccgaggcgggcctcgaatacggccccgccttccagggcgtccgcgcggcctgggcgagcgacgacgcggcctacgtcgagatcgcggccgccgacggacagtgggccgatgccccgctgttcggactgcatcccgcgctcctcgactcggcgctgcacgccatcggtctggccgggctcgtcgaggacaccggccgcggccggctgcccttctcctggtccggggtgtccctgtacgccgtgggcgcctcggtgctgcgcgtacggctggccaaggccggaccggacgcggtgtccctggccctcgccgacggcgccggacagcccgtgggcgacatcgcctcgctcaccctgcgccctgtctcggccgagcagctggacaccgggcggggcggtcaccatgacgcgctgttccaggtggactggaccccgctgaacctgccccgtgctgtcgacagccgctgggccgtgctcggcgagcccgtccccaccgacgagccgggcgacggcgtggcgcgccacgcggacgcggaggcgctgagcgcggccctcgacgcgggtgctccggtgccggatgccgtactcgtacgccaccccgccctgcccgaacccacccccgaggcggtccaccaggccgcgcaccggaccctcggcctgctgcggcactggctcggcgacgaccggctcgccgacagccgcctcgtcctgctcacgcacggcgcggtcgccgcgggagacgcggaccaggtacccgacccggtgcacgccgtggtctgggggctggtccgctccgcacagtccgagcacccgggccggttcctgctgatcgacagcgattccggtatcgacacactctcctggccgacgttcggtgccgttctcgcctccgaggagccgcaggtcgccctgcgcggcggcgtggcccacgcacccaggctggccaaggttcccgccaccgctaccgccgctgccgtcgtcgagacgtcgtcgtacgaccctgacggcaccgtcctcgtcaccggggccagcggcacgctcggcggactcgtcgcccgtcacctcgtgaccgggcgcggcgtacggcgtctgctgctgctgagccgtcggggcgccgatgcccccggtgccggtgaactggccgctgagctgaccgggttgggtgccgaggtgtcgtgggcggcgtgtgacgcgggtgaccgcgacgcgctcgcggccgtactggccgccgttcccgcagcgcacccgctcaccgcggtcgtccacacggccggtgtcctcgacgacggcgtgatcggttcgctcaccccggagcgcctcgacacggtccttcgcccgaaggccgacgccgctctccacctgcacgaactgacccgcgacctgcccctgaccgccttcgtcctcttctcctccgcggccggggtcttcggcgcaccgggtcagggcaactacgccgccgccaactccttcctggacgccctcgcccagtaccggcgtgcccacgggctccccggccggtcgctggcctggggcctctgggaggacgccgaaggcatggcgggcgccctcgaccgcgccgacctcgaccggatgaagcgcggcggagtccacggactcaccgcctccgagggcctcgcgctcctcgacctcgccgacgccctcggcgcggaccgtgacgaccagggccaggatcaggagacggccggacgggcgctgctcgtgccgatgcggctgacccttcccgccgtcgcccccggcgccgaagtcgccccgctgttccggggattggtccgcacccccgcgagacgcgtcgcggccggagccaccacgggagccaccaccggaaccgggcccgacctctccgctctcgaacggcggctcctcggcctcgacgcgccggagcgggagcggctgctcctcgacctcgtccgcggccatgtcgccgacgtgctcggccacggctccccggacgccatcgaccccgaacaggccttcagcgagctgggcttcgactccctgacggcggtggaactgcgcaaccgcctgggcgcggccatcggccggcggctgcccgccacgctgatcttcgaccacccggcctcgctcaccctcgcccgtcacctctccggtgaactcgccgggtcccaggccgcgttggcgccagccgggcccgcgcccaccgtgaccgacgacgacccgatcgccatcgtggcgatgagctgccgctaccccggcggcgtgaccacccccgaggagctgtggcagctcctcgcgggcggcggggacgcgatatccggcttccccgccgaccgcggctgggacgtcgagtcgctgtacgaccccgatcccgaccacccgggcacctcgtacacccgccacggcggcttcctgcgcgacgccgccgcgttcgatccgacgttcttcgggatcagcccgcgcgaggccgtcgggacggacccgcagcagcggctcctcctggagaccacctgggaggcgttcgaacgggccgggatcgacccggccaccgtgcgcggcagccggaccggtgtgttcgcgggcgtcatgtaccacgactacgcggccctgctggagcgctcgaaggacggagcggacggctccctcggctcgggcagcaccggcagcatcgcctcgggccgggtctcgtacaccttcggtctcgaaggccccgccgtcacgatcgacaccgcctgctcgtcgtcgctcgtggccctgcacatggccatccaggcgctgcgcaccggcgagtgcgacatggcgctggccggcggtgtcaccgtcatggcgacccccggcacgttcatcggcttcagccgtcagcgcggcctgtccgccgacggccgctgccgcgccttctcggccgacgccgacggtacgggctggggcgagggcgtcggcatgctcctcgtggaacgcctgtccgacgcccgccgcaacgggcatccggtcctggccgtggtccgtggctcggcgatcaaccaggacggcgcgagcaacggcctcaccgcccccaacggcccctcgcagcagcgcgtgatccgcgcggccctcgcgagcgcgggcctgtcggccgccgaggtcgacgcggtcgaggcgcacggcaccggtacgacgctcggcgatccgatcgaggcgcaggcgctcctggccacctacggccgggagcacaccgaggacagcccgctgtggctcggctcgatcaagtccaacatgggtcacacgcaggcggccgccggtgtcgcgggcgtcatcaagatggtcctcgccatccagcacggcgtgctgccgcgcaccctgcacgcggaccggccctcgccccacgtggactggtcgcagggcgccgtctcgctgctcaccgagtccgtcccgtggccggagacgggccgtccgcgccgcgcgggcgtgtcgtcgttcggcatcagcggcaccaacgcgcacacgatcatcgagcaggcgccggaggaggccacggtggccccggccgacgcggtggccgcgccgagcgcgctgcccctgcagctcgcgggccgcagcgccgaggcgctctccgcccaggcccgtgcgctgagcgcacacctgaccgcacaccccgacgtccccctcgcagacctcgcctactccctggccacgagccgtgccaccttcgaccaccgggcggtcctggtcgcgacggagggcacaacggccgccacggccgtcacggcgctcgacgccctcgccgaccggcgcacggcaccgggcctggtgcggggcacggccagcaagggcggtcgcacggcgttcctgttcacggggcaggggagccagcggctggggatggggcgtgagctgtacgaggcgcatcccgtcttcgcgcgggctctcgacgcggtgtgtgatcgcctggaactgccgctgaaggatgtgctgttcggtactgacgcgggtctgctgaacgagaccgtgtacacgcagccgggtctcttcgccgtcgaggtggcgctgttccgtctgctggagagctggggtgtgaagcccgacttcctggccgggcactcgatcggtgagatcgccgcagcccatgtggccggggtgctctccctcgatgacgtgtgcgctctggtggaggcgcgtgggcggttgatgggtgcgctgccgggcggtggcgtgatgatcgccgtccaggcgtctgaggctgaggtcctgccgctgctgaccgaccgggtgagcattgccgcgatcaacggcccccggtcggtcgtcatcgcgggcgacgaggccgacgcggtcgcgatcgtggagtccttcacggaccgcaagtcgaagcggctcacggtcagtcacgccttccactcgccgcacatggacggcatgctcgacgccttccgtgaaatcgcggagggtctgtcgtacgaggctccgcgcatcccggtcgtctccaacctcaccggggccctggtctcggatgagatgggttcggcggacttctgggtgcggcacgtccgtgaggccgttcgtttcctggatggcatccacgccctggaggccgcgggcgtgacgacgtacgtcgaactcggccccgacggagtcctgtcggcgatggctcaggagtgcgtgaccggcgaggactccgtcttcgtgccggtcctgcgctcgggtcgtcccgaggccgagagcgtcaccacggccctcgcccaggcgcatgtccgcgggatcgccgtcgactggcaggcgtacttcgccgggaccagtgcccagcgcgtcgacctgcccacctaccgcttccagcgcgagcactactggcccgagacgggcatccccctgcccggcgacaccgctgggctcgggctcgccgccgcgggtcatccgctgctgggtgcggccgtgacactcgcggacgccgacggatgcgtcctcaccggtcggctctccctgcggacgcatccctggctcgcggaccacgccgtcatggggtccgtactgctcccgggaacggctctcgtcgaactggccctgcatgcgggcgagcgcgtcggaacccgtgccctggacgagctgacgcttcaggccccgctgatcctgccgaacgagggcgcggttcagctgcaagtcgtggtcggtgcgcccgatgccgcgggccaccgcacggtggccgtgtactcccgcccggacgccgacggcgaagcgtgggtccggcacgccgacggactgctggtggacgaggtccggggcgccgccgccgacctcggcgtctggcccccggccggtgcgaccgccgttccggtggacgacgcctacgcgatcttggagacctcggggctcgcgtacggccccctgttccaggggctgcgggcggcctggcggcgagcaggagagctgttcgcggaactggccctgcccacggaggcgcaggcggacgccgccgcgttcgggctgcaccctgcgctgctggactcggcgctgcacaccctggcgctgggtgatctgctgtccggcgcggacgcggaggaaacgcccggcgccgcacggctgccgttcgcctggcgtggtgtccgcctccacgcggccggtgccccggcggtacgggtccggctggccgaggccggtcagggcgcggtgtcgctggaactggccgactccgcgggtgcccccgtcgcctcggtggattccctggtactgcgggcgatgtcgcccgagcagctcggcgcggcgagcgccggccgccaggagtcgttgttccagatcgactgggtggagccggcggccgaccggacggcggctgcgaccgatgtcgaacgggccctggtgggcccggagctgcggggtctggacgccacgccgtacgccgacctggccgcgctggcggccgcggactccgacgtgcccgaactcgtgttcatcaccacgcgagcggagtcggagccggagggcctgccggggacggtgcacgtccgggccgtcgacgcgctcacccacgtacgggcatggctggccgaggaacgcttcgcgtccgcccggctggtgttcgtcacccgcggtgccatgaccgtgggttcggacgaggccgtccgcgatctcgcgggtgccgcggtgtggggtctggtccgctccgccggtaccgagcaccccggccggttcgctctcgtcgatctcgacgacgacgacgtgctgcccgagcagaccgtcctgacggccctggccgcaggggaatcggaactggtcgtacgcgagggatccctccttgtgccgcgcctcgcgcgtgctgctgtcgttgagggttccggtcgtgaactggacgtcgacggcacggtgttggtgacgggtgcgagtggcaccttgggtggtttgttcgcccgtcatttggtggttgagcgtggtgtgcggcgcctgctgttggtgagtcgtcgtggtggggctgcggagggtgctgctgaactgggcgccgaactcacggagctgggtgctgatgtgcggtgggcggcgtgtgatgtggccgaccgtgaggcgcttgagtcggtcctggccgggattcccgccgagtatccgttgtcgggtgtggtgcataccgctggtgtgctggacgacggtgtggtgtcgtccctgaccgctgagcgcgtgtcggcggtgctgcgtccgaaggtggacgcggcatggaacctgcatgagctgacccgtggcctggatctttctctcttcgtgttgttctcgtcggctgccggtgtgttcggtggtgccggtcaggcgaactatgcggcggcgaatgtgttcctggacgctctggcccagcaccgcagggcccagggtctggccgcgacctcccttgcgtggggtctgtgggctgagccgggtggtatggcgggcgcgctggacgctgatgatgtgtcgcgtctgggccgtggtggtgtcagcgggctgtccgcgggggagggtgtggcgttgttcgacgcggcatccgcgtccgaacaggccttgttcgttcccgtgaagctggacctggccgccctgcgcgcccaggcgggtagcgggatgctgccgccgctgctcagcggtcttgtccgtacccccacccgccgcgccgcgggcaccgccaacgctgcggtatccgccccgggggaccgcctcgccggattgtccgccgctgaacaggtggcgcacgtactggagttggtccgtactcaggttgccgcggtgctggggtacgcctccccggaggcggtcgagaaggacagctcgttccgcgagctgggcttcgactcgctgaccgccgtcgagctgcgcaacctgctcggcgcggcgacggggctgcgcctgcccgccacgctcgtcttcgactacccgacctcagcggtcctggccgaccacctgcggtcggagctggtcggaacggcgcccgtgacatcggctccggtcgttctcgcggcccgggacgatgacgagcccatcgcgatcgtgggcctcggctgccgctaccccggcggcgtggagagcccggacgacctctggcggctcgtcctggaaggccgggatgccatcacggagttcccggaggaccggggctgggacgtggacgcgctgttcgacgccgaccccgaccagcagggtacgagttatgcccgcgagggcggcttcgtccgcgacgcgggccacttcgacccggcgttcttcgggatctcgccgcgcgaggccgtggccatggacccgcagcagcgactcctcctcgaaacctcgtgggaggcgttcgaacgggcgggcatcgacccggcggccctgcgcggcagccggaccggcgtcttcgcgggtgtgatgtaccacgactacgcttcccggctcacggccctccccgagggcgtcgagggcttcctcggcacgggcaacgcggcgagcgtcatctccggacggctgtcgtacgccttcggcctggaaggcccggccatcaccgtcgacacggcctgctcgtcctcgctggtcgccctgcacctggcggtgcaggcgctccgcaacggcgagtgttccctcgctctcgcgggcggtgtcacggtcatggcgacccccgctgccttcgtggagttcagtcgccagcgcgggctcgcggccgacggccggtgcaaggcgttctcggccggcgccgacggcacgggctggtccgagggcgcgggcgtcctgctggtggagcggctctccgacgcgcggcgcaacggtcacccggtgctcgcggtggtccgtgggtcggcgatcaaccaggacggtgcgagcaacggtctgacggctccgaacggtccctcgcagcagcgggtgatccgccaggcgctggccagcgcgggcctgtcggcggcggatgtggacgtcgtggaggcgcacggcaccggcaccaccctcggcgacccgatcgaggcgcaggcgctcctcgccacctatggccaggagcacacggacgagcagccgctgctgctcggctcgatcaagtccaacttcggccacacgcaggccgccgccggtgtcgcgggcatcatcaagatcgtccaggcgatgcgtcacggtgtcgtccccaagacgctgcacgtggacgagcccaccccgcacgtcgactggtcggcgggcgcggtctcgctcctcaccgagcaggtggcctggcccgaaaccggccgtccccgccgcgcggcgatctcttccttcggcttcagcggcaccaacgcgcacgccatcatcgagcaggcccccgaccccgctcccgaggacctgcccgacgcaggacccgacgtacggcccgagcccgcccggactccgggcagcctgccgtggctcctctcggcgaagggcgcggacgccctgcgcgaccaggccgcccggctccgggcgcatgccatcgggcaccccgagctgtccctcgccgacatcggctacgccctggccacgagcaggaccgcgctcgaccggcgggccgccgtggtcgccggggaccgcgaggagttcctcgcgggactcgcggcgctcgccgagggtgccacggcggccggcctgacggagggatcaccggccggtggcaagctcgccttcctgttcaccgggcagggcagccagcgcctggccatgggcagggagctgtactccgcccatcccgtcttcgcccgggccctggacgccgtgtgcgacgggctcgccctggacgtaccgctgaagcaggtgctgttcgggtccgacgcggacctgctcgaccggaccgcgtacacccagcccgccctcttcgccgtcgaagtcgcgctgttccgcctggtcgagagctggggcctgaagcccgacttcctggccgggcactccatcggcgagatcaccgcggcccatgtggccggggtgctctccctcgacgacgcctgcacgctggtcgccgcccgcggccggctcatgcaggcactgcccaccggcggcgtgatgatcgccgttgaggcatcggaggacgaggtcctgccgctgctcaccgaccgggtgagcatcgccgcgatcaacggcccccagtcggtcgtgatcgcgggtgacgaggccgacgcggtggcgatcgcggagtccttcaccggtcgcaagtccaagcggctcacggtcagccacgccttccactcgccgcacatggacggcatgctcgacgccttccgcgaggtcgccgagggactgtcgtacgggaccccgctcatcccggtcgtctcccacctcaccgggaccctggtcaccgacgagatgcggtcgccggacttctgggtccggcacgtccgcgaggcggtccgcttcctggacggcatccgcacgctggaggacgcgggcgtcaccacgtacatcgaactcggccccggcggcgtcctctccgcgatgggtcagtcgtgcgtcacgcgcgacgacgcggccttcctcccggccctgcgcgcggaccgctccgaagaggagacgctcacctcggccgtcgcccgggcacacctgcgcgggatcaccgtcgactgggacgcgtactactccggcaccggcgcccggcgcgtcgacctgccgacgtacgccttccagaggcagcgctactggctggaggcccccgcccacgcccccggcggggacgtgacgtccgccgggctcggctccgcggggcacccgctcctcggcgcggccgtcgaactgccggactcggacgggttcctgttcaccgggcggctctccctgcgcacccacccctggctcggcgaccacagggtggcgggcaccgtcctgctgccgggcgccgcgctgctggaactcgccgtgcgcgccggggaccacgcgggctgcgatctgctggaggacctcacgctggaggctccgctcgtactgcccgaggcgggcggggtacagctgcggctcgtcgtggccgaacccgacgcgtcgcgcaggcgggtgttccacatctactcccgcccggaggacgcggccttcgaggagccgtggacccggcacgccggcggtgtcctggccgtcgagggcgcgcacccggccgaggcggagtccgagtggccgcccgccggagccgtcccctgcccggtggaggacctctacccgtcgctcgacgccatcgggctcggatacggtcccgcgttccgcaatctgctgctggcctggaagcgcggcgacgaggtgttcgccgaggtcgctctcggcgaggaccggcggaccgaaggcgccctctacgggctccacccggcgctgctcgacgccgccctgcacgcggtcggcctcggggacttcttccccgacgggcccgagggcgcgcggctgccgttctcgtgggacggcgtgcggctgcacgccgtgggcgccgcggcgctccgggtacggatggcaccggccgggcaggacgcggtcacgctggccgtctccgacgaaacgggccggccggtcctcaccgtcgactcgctcgtcctgcgtccgctggccctcgatggtccgggcgggctcggcggagcgggccggggaccgggttcggtgcgcgacgcgctgttccaggtcgactggcacgcgctgccgctgcccgaggcgcagtcaccggccgaaggccgctgggccctgctcggcggcgacccgctgaagctggccgccgcgctggagcgcaccggggtcctggagccgggcgcgctgttcggcacggcctccgaggacaccggcgggcaccctcgcgacctgtccgccctggcggacgcggtcgagctggccgaggcactcggggagcccgcgcccgagaccgtcctcgtctccctggcacccgacctcgccgccacgggcggcctcgcgtcggccgcccaccgcgccgccgcggacgcgctggagctgatccaggcctggctggcggacgagcggctcgccggttcacggctggccctcgtcacgcggggcgccgtcgccacggaccccgacgcggacgtggacgacctcgcgcacgccgcggtgtggggactggtgcgctccgcgcaggccgagcaccccggccggctggttctggtcgacctcgacgacgaggacgactcctaccgggccctgcccgccgcgctcgacaccgatgagacccagctcgccgtgcgcgacggggccgtcctggccccgcgtctggcgcgagcggtcatcgccccggcaacggatgcggcggccccggacgttgccccggacccggagggcaccgtcctcatcacgggcgccagcggcaccctcggcggcctgctggcccggcacctggtgacggagcacggtgtgcggcatctgctgctcaccagccgcaggggcgccgctgccgaaggcgccacccaactcgcagacgaactcgtcacgttgggtgcgcaggtcacctgggcggcgtgtgacgcggccgaccgggacgcgctggccgcgctgctggagtccgtacccgcggcccatccgctgacggccgtcgtgcacaccgccggtgtgctggacgacggcacggtcgagtcgctgaccgccggacggatggcgacggtgctgcggcccaaggtcgacgccgcgtggaacctgcacgaactgacccacggactcgacctggccgcattcgtcctgttctcctcggcggccggtgtgttcggcaacgccgggcaggccaactacgcggcgggcaacaccttcctggacgccctcgcccagcaccgccgcgcccagggcctcacggccgtctcactggcctggggtctgtgggacgacgaggcgggcatggcagccaccctcgacgagcaggaccggcggcgcctgagccggggcagcatgaacccgctgtcggtggccgaggggctcgcgctcttcgacgccgcgctgccgggcggggcatcctccggcgccgtgcccgagggcgcgcggaccgcgagcgtactcgtgcccgcgcggctcgacttggccgtgctccaggcccaagtgggggatctcgtaccgcccttgctgcgcggcctgctccgtactccggtacggcgcagggcgagcggcgcggcggccgacgcgcccgactcgctggcgcagcggctcgcccaactgccgcccgccgaacgggaccgggtgctgctcgacctcgtctgcacccaggtggcccaggtgctgggccacagcggcgcggccgccatcgaaccgggaagcgccttcaaggaactcggcttcgactcgctgaccgcggtggagctgcgcaaccggctcggtgccgtgacggggctgcgcctccccgccacgctcatcttcgactacccgacccccgaagcgctgagcggacatctgcgctccgcgctgcccctcgacgaggacggaccgtccgtcttcagcgaactcgaccggctggagagcgccttgggcgcggcggacgcggacagcgtcacgcgttcacggatcacgatgcgcctccaggccctgatgaccaagtggaacgacgcacaggacgcgaacggcggcgcccccgacgaggacgccgacgacggcgccctcgaaacggcgaccgacgacgagctgttcgacctgctcgacaacgagctcggcgcctcctga

SEQ ID NO: 33 - protein, 3227 aa, Streptomyces aizunensis
MVNEDKLRDYLKRATADLRQARRRLREVEDKNQEPIAIVAMSCRYPGGVRSPEDLWRLVENGDDAVSGFPVDRGWDVEALYDADPDSSGSSYVSEGGFLYDAASFDPAPFGISPREALAMDPQQRLLLEASWEAFERAGIDPSSVRGSRTAVFAGVMYHDYTARLDSVPEGVEGFLGTGSSGSIASGRVAYTFGLEGPAVTVDTACSSSLVTLHLAVQALRAGECSMALAGGVTVMATPATFTEFSRQRGLAPDGRCKPFAAAADGTGWGEGVGMLLVERLSDAQRNGHPILAVVRGSAINQDGASNGLTAPNGPSQQRVIHQALTNARLSAADVDVVEAHGTGTTLGDPIEAQALLATYGQDRPAGRPLLLGSIKSNIGHTQAAAGVASIIKMVEAMRHGVVPKTLHLDEPTPHVDWEAGAVSLIGEKIAWPETGELRRAGVSSFGFSGTNAHVIVEQAPVVEEVAGDPAGEVEGSELAVVPWVLSGKSAGALRAQAERLSGWLAGASAAGVASVDVGWSLASSRAGLEHRAVVLGDHAAGVGAVASGVMAAGVVTGSVVGGKTAFVFPGQGSQWVGMAVGLLDSSPVFAARVDECAKALEPFTDWSLVDVLRGVEGAPSLERVDVVQPALFAVMVSLAEVWRAAGVRPGAVIGHSQGEIAAACVAGILSLEDAARVVALRSQAIGRVLAGLGGMVSVPLPAKAVRELIAPWGEGRISVAAVNGPSSVVVSGEAAALDEMLASCESEGVRAKRIAVDYASHSAQVELLREELAELLAPIVPRAAEVPFLSTVTGEWVRGPELDAGYWFQNLRRTVELEEATRTLLEQGFGVFVESSPHPVLSVGMQETVEDAGREAAVLGSLRRGEGGLERFWLSLGEAWVRGVAVDWHAVFAGTGARRVDLPTYAFQQEHYWLESGTAEDVTATAHPVDAVEARFWEAVERQDVAALTAELDVDENENLTALLPALSSWRRQSRERSAVDGWRYRVTWKPAPEPTTARLSGTWLVAVAEGAPGDEWTSAVLRTLAEHGADVRQITVARTEDTRAGLAERIRDVLADGPAVSGVLSLLTPAGADEPFQVSAPGGVITTLSLVQALGDAEVAAPLWCVTRGAVATGRSEQVADPAQAPVWGLGRVTALEHGERWGGLIDLPGTDAVDDRALARLAGVLAGDAAEDQVAVRASGLFVRRLVRVRLAETPVVREWRPQGTTLVTGGTGALGAHVARWLAENGAEHLLLTSRRGPDAPGAAALRDELTALGAQVTIAACDVSDRDAVAALIAAVPADQPLTAVVHTAAVLDDGVIEALTPEQIERVLRVKVDATLHLHELTRELDLSAFVFFSSFAATFGAPGQGNYAPGNAFLDAFAEYRRASGLPATSIAWGPWGDGGMAEGAVGDRMRRHGVIEMSPERAVAALQHALDRDETTLTVADMEWKRFVLAFTSGRARPLLHDLPEAREVMDATRTEAAEDTGSAAALAQQLTGRPEAEQERLLLELVRTAVAAVLGYAGPDAVEAGRAFKELGFDSLTSVELRNRLNAASGLKLPPTLVFDHPTPTVLARHLRAEFFGQGAAAAVPVPMAAVSDDEPIAIVAMSCRFPGGVRNPEELWQLLTSEGDGLSQFPLDRGWDVDALYDPNPDAQGTSYTREGGFLSDAAAFDSSFFGISPREALAMDPQQRLLLETSWEAFERAGIDPQTLRGSQSGVFVGTNGSDYSNLVRAGADGLEGHLATGNAGSVVSGRLSYTFGLEGPAVTVDTACSASLVALHLAVQALRSGECSLALAGGVTVMSTPGTFIEFSRQRGLSTDGRCKAFSSDADGFSPAEGVGVLLVERLSDARRNGHPILAVVRGSAINQDGASNGLTAPNGPSQQRVIRQALANARLSAADVDVVEAHGTGTTLGDPIEAQALLATYGQDRPAGRPLLLGSIKSNIGHAQAAAGVAGVMKMVLAMQHGVLPQSLHIAEPTPHVDWSAGEVALLTEERAWPETGRPWRAGVSSFGFSGTNAHAIIEQAPAEAGSDDDRETPEPSAQPLLVAPTRDDSASARDDSASAPDGSVSGPDDSVSDRPGVLPWTLTAKTEKALQGQAERLLTQLTTRSDLRLVDVGHSLATTRTALDQRAVLIGRDRPDYLGALTALAAGDTSPLLVQGAVVGGKTAFVFPGQGSQWVGMAVALLDASPVFAARVDECAKALEPFTDWSLRDVLRGVTGAPSLDRVDVVQPALFAVMVSLAEVWRAAGVRPDAVIGHSQGEIAAACVAGILSLEDAARVVALRSQAIGRVLAGLGGMVSVALPAKAVRELIAPWGEDRISVAAVNGPSSVVVSGETAALDELLASCESDGVRAKRIAVDYASHSAQVELLREELAELLAPIVPRAAEVPFLSTVTGEWVRGPELDGGYWFQNLRRTVELEEATRTLLEQGFGVFVESSPHPVLTMGVQETVEDAGRDAAVLGSLRRGEGGLERFWLSLGEAWVRGVGVDWSAVFAGTGARRVDLPTYAFQSQRFWPEAAPIEAVAVSAESAIDARFWEAVEREDLEALTAELDIEGDQPLTALLPALSSWRRQSREHSTVDGWRYRVTWKPLAEAKTSRLSGTWLVVVPENGPADEWTGAVLRVLADRGAEVRTVTVPADGADRDRLAATLKAETDGAAPAGVLSLLALAVESAELRTHTGLLATAALVQALGDADVAAPLWCVTRGAVSVARTERLQDPAQALVSGFGRTVALEYPDRWGGLVDLPEQADGRTLERLAGVLAGDGSEDQVALRASGLFGRRLVHAPLADTAAVREWRPQGTTLVTGGTGALGAHVARWLAENGAEHLLLTSRRGPDAPGAAELRDELTALGAQVTIATCDMADRDAVAALIAAVPADQPLTAVMHTAGVLDDGVIDALTPERFGTVLAPKADAALTLHELTRELGLSAFVLFSGVAGTLGDAGQGNYAAANSYLDALAEQRHADGLAATSVAWGRWGDSGLAAGGAIGERLDRGGVPAMAPRSAIRALQLALDHAEAAVAVADIQWERFAPGYTAVRPSPFLGDLPEVRQLAASAPAAGEAGGDSPAEALRRRLAVMPQAEQALAVLELVRSHAATALGHPTTDEVGAGRAFKELGFDSLIALELRNRLNAATGLRLPATLVFDHPTPTILAEFLRAEITQDGSAGAAPGITELEKLESALSVLDPDSETRTDIALRLQALLAKWGEPHIESSGEAVTEKLQEATPDELFEFIEKEFGI

SEQ ID NO: 34 - DNA, 9684 bp, Streptomyces aizunensis
atggtgaacgaggacaagcttcgcgactacctcaagcgggcgaccgccgatctgcgccaggcccgcaggcggctgcgcgaggtcgaggacaagaaccaggaacccatcgccatcgtcgcgatgagctgccgctaccccggcggcgtccgcagccccgaggacctgtggcggctcgtggagaacggcgacgacgccgtctccggcttccccgtcgaccgcggctgggacgtggaggcgctctacgacgccgaccccgacagctccggatccagctacgtcagcgagggcggcttcctctacgacgccgcgagcttcgaccccgcccccttcgggatctcgccgcgcgaggccctcgccatggacccgcagcagcggctgctcctcgaagcgtcctgggaggcgttcgagcgcgcgggcatcgacccgtcgtccgtgcgcggcagccggacggccgtgttcgccggtgtgatgtaccacgactacaccgcgcgcctcgattccgtgcccgagggcgtcgaaggattcctcggcaccggcagctcaggcagcatcgcctcgggccgggtggcctacacgttcggcctggagggcccggcggtcaccgtcgacacggcctgctcgtcctcgctcgtcaccctgcacctggccgtccaggcgctgcgggccggcgaatgctcgatggcgctcgcgggcggtgtcaccgtcatggcgacccccgcgaccttcaccgagttcagccgccagcgcggcctcgcgccggacgggcgctgcaagcccttcgcggccgccgcggacggtacgggctggggcgaaggcgtcggcatgctcctcgtcgagcgcctttcggacgctcagcgcaacggacatccgatcctcgcggtggtccgcgggtcggcgatcaaccaggacggtgcgagcaacggcctgacggctccgaacggtccgtcgcagcagcgcgtcatccaccaggcgctcaccaacgcacggctgtcggccgcggatgtggacgtcgtcgaggcgcacggtacggggacgaccctcggcgacccgatcgaggcgcaggccctgctcgccacctacggccaggaccgcccggccggacgcccgctgctgctcggctccatcaagtccaacatcggccacacccaggccgccgcgggtgtcgcgagcatcatcaagatggtcgaggcgatgcgtcacggagtggtccccaagaccctccacctcgacgagccgactccgcacgtggactgggaggcgggcgccgtctccctgatcggcgagaagatcgcctggccggagaccggtgaactccgtcgtgcgggtgtgtcgtcgttcgggttcagcgggacgaacgcgcatgtgatcgtcgagcaggctccggtggtcgaggaggtggcgggggatccggccggtgaggtcgagggttcggaactcgcggtggtgccgtgggtgttgtcgggcaagagtgcgggggcgttgcgggcgcaggcggagcggttgtcggggtggctcgccggtgcttcggctgcgggtgtggcgtcggttgacgtgggctggtcgttggcgtcgtcgcgggccgggctggaacaccgggctgtggtgctgggcgatcacgcggccggtgtgggggcggtggcgtcgggtgtgatggccgcgggtgtggtgacggggtcggttgtcggcgggaagaccgcgttcgtgttcccggggcagggctcgcagtgggtgggtatggcggtggggttgctggattcctcgccggtgttcgctgcgcgggtggatgagtgtgcgaaggcgttggagccgttcactgactggtcgttggtggatgtgctgcggggtgtggagggtgcgccgtcgttggagcgggtggatgtggtccagcctgctctgttcgcggtgatggtgtcgttggcggaggtgtggcgggctgctggtgtgcgtcctggtgcggtgatcggtcattcgcagggtgagatcgctgcggcgtgtgtggcggggatcttgtcgcttgaggacgccgcgcgagtggttgcgttgcgcagtcaggcgatcggccgggtcctggcaggtctcggcgggatggtgtcggtgccgctgcccgcgaaggcagtacgagagctgatcgctccgtggggtgagggccggatctcggtggccgcggtgaacgggccgtcctcggtggtcgtttcgggtgaggccgccgccctggacgagatgctggcctcgtgcgagtcggagggtgtgcgggcgaagcggatcgcggtggattacgcgtcgcattcggctcaggtggagttgctgcgggaagagcttgctgagctgctggctccgattgttccgcgcgctgctgaggtgccgttcttgtcgacggtgacgggtgagtgggtgcgaggcccggagctggatgctggttactggttccagaatctgcgccggacggtggagttggaagaggcgacgcggacgttgctggagcagggcttcggtgtgttcgtcgagtcgagcccgcacccggtgttgagcgtgggcatgcaggagacggtcgaggacgcgggccgggaggcggctgttctgggttcgctgcgtcgtggtgaggggggtctggagcgtttctggctgtcgctgggtgaggcctgggtccgtggcgtggctgtcgactggcatgccgtgttcgcgggtacgggtgcccggcgggtggacctgcccacctacgccttccagcaggagcactactggctcgaaagcggcaccgccgaggacgtcacggccaccgcccaccccgtcgacgccgtcgaagcccgcttctgggaggccgtcgagcgccaggacgtggcggcgctcaccgccgagctggacgtggacgagaacgagaacctcaccgcgctgctgcccgcgctgtcgtcgtggcgtcggcagagccgtgagcggtccgccgtggacggctggcgctaccgggtgacctggaagcccgcgccggagcccacgacggcccgcctctccggcacctggcttgttgccgtcgccgagggcgcgccgggtgatgagtggacgtccgctgtcctgcgtacgctcgccgaacacggcgccgacgtacggcagatcacggtcgcccggaccgaggacacccgggccggtctcgccgagcggatacgtgacgtactcgcggacggtcccgcggtgtcgggagtcttgtccctgctgaccccggcgggggccgacgagccgttccaggtctccgcgcccggcggtgtgatcaccaccctgtccctcgtccaggcgctcggcgacgccgaggtggccgcacccctgtggtgcgtcacgcgcggcgccgtcgccaccggccgttccgagcaggtggccgaccccgcgcaggctccggtctggggcctgggccgggtgaccgcgctggagcacggcgagcgctggggagggctgatcgacctgcccggcacggacgccgtggacgaccgggcactcgcccggctcgcgggcgtcctcgccggtgacgccgccgaggaccaggtggcggtgcgcgcctccggcctcttcgtacgacggctcgtacgcgtccgtctcgccgagacgcccgtcgtacgggagtggcgtccgcagggcaccaccctggtcacgggcggtacgggcgcgctgggcgcgcacgtggcccgctggctcgctgagaacggcgccgagcacctgctgctcaccagccgccggggccccgacgcgcccggagccgccgcactccgcgacgaactcaccgccctcggcgcccaggtcaccatcgcggcctgcgatgtgagcgaccgggacgccgtcgcggccctcatcgccgcggttcccgccgaccagcccctcaccgccgtcgtgcacacggcggccgtcctcgatgacggggtcatcgaggcgctcacgcccgagcagatcgagcgcgtcctgcgggtgaaggtcgacgcgacgctgcacctgcacgaactgacccgcgagctcgacctgtcggcgttcgtgttcttctcgtccttcgccgccaccttcggcgcccccggccagggcaactacgcgccgggcaacgcgttcctggacgccttcgccgagtaccgccgggcatccggactgcccgccacctccatcgcctggggcccttggggcgacgggggcatggccgagggcgcggtcggtgaccggatgcgccgccacggggtcatcgagatgtcgcccgagcgtgccgtcgccgcactccagcacgccctggaccgcgacgagacgaccctgaccgtcgccgacatggagtggaagcgcttcgtcctcgccttcacctccggccgcgccaggccgctgctgcacgacctgcccgaggcgcgggaggtcatggacgccacgcgcacggaggcggcggaggacaccggcagcgccgccgcgctggcccagcagctgaccggccggcccgaggccgaacaggagcgactgctcctcgaactggtccgcaccgccgtcgccgccgtcctcggctacgcgggccccgacgcggtcgaggcgggccgggccttcaaggagctgggcttcgactccctcacctccgtcgaactgcgcaaccgcctgaacgcggccagcggcctcaagctgccgcccaccctcgtcttcgaccacccgacgcccaccgtcctcgcccggcacctgcgggccgagttcttcggccagggcgccgcggccgccgtgcccgtgccgatggccgcggtctccgacgacgagccgatcgccatcgtcgcgatgagctgccgcttccccggcggggtccgcaaccccgaggagctgtggcagctgctcacctccgagggtgacgggctgtcccagttccccctggaccgcggctgggacgtcgacgcgctgtacgaccccaaccccgacgcgcaaggcacctcgtacacgcgggagggcggcttcctgtccgacgccgcggccttcgactcctcgttcttcgggatctcgccgcgcgaggccctcgccatggacccgcagcagcggctgctcctcgaaacctcgtgggaggcgttcgagcgggcgggcatcgacccgcagaccctgcgcggcagccagtccggtgtgttcgtcggcaccaacggctctgactactccaacctcgtacgggcgggggcggacggcctggaggggcacctggccaccggcaacgcgggcagtgtcgtctccggccggctctcctacaccttcggtctcgaaggcccggccgtcaccgtcgacaccgcctgctcggcctccctcgtcgccctccacctcgccgtgcaggccctgcgcagcggtgaatgctcgctcgccctggccggtggcgtgacggtgatgtccacgccgggcaccttcatcgagttcagccgtcagcgcggactctccaccgacggccgctgcaaggcgttctcctcggacgccgacggattcagccccgcggagggcgtcggcgtgctcctcgtcgagcgcctttcggacgctcggcgcaacgggcatccgatcctcgcggtggtccgtgggtcggcgatcaaccaggacggtgcgagcaacggtctgacggctccgaacggtccgtcgcagcagcgcgtcatccggcaggccctcgccaacgcacggctgtcggccgcggatgtggacgtcgtcgaggcgcacggtacgggtacgacgctgggtgacccgatcgaggcgcaggccctgctcgccacctacggccaggaccgcccggccggccggccgctgctgctcggctccatcaagtccaacatcggccacgcccaggcggcggccggtgtcgcgggcgtcatgaagatggtgctcgccatgcagcacggagtgctgccgcagagcctgcacatcgccgagcccacgccgcacgtcgactggagcgcgggcgaggtcgccctgctcaccgaggagcgggcctggcccgagaccggccgcccctggcgggcgggcgtctcgtcgttcggcttcagcggcaccaacgcccacgccatcatcgagcaggctccggccgaagcgggatccgacgacgaccgggagacccctgagccgtcggcccaacccctactggtcgcgcccacccgggacgactccgcgtccgcccgggacgactccgcgtccgccccggacggctccgtatccggcccggacgactccgtgtccgaccgtcccggcgtgctgccctggaccctgacggccaagaccgagaaggcgctgcaaggccaggccgaacgcctgctgacccagctcaccacccgctctgacctgcgacttgtcgatgtcggccactccctggcgacgacccgtaccgcgctcgaccagcgcgccgtcctcatcggacgggaccgccccgactacctcggagccctgaccgcactcgcggcgggggacacctcccccctgctggtgcagggggcggtcgtcggggggaagacggcgttcgtgttccccggacaggggtcgcaatgggtaggcatggcggtggcgctgttggacgcttcacccgtgttcgctgcccgagtggatgagtgtgcgaaggcccttgagcccttcaccgactggtcgctgcgcgatgtactgcgcggcgtcacaggcgcgccgtcgttggaccgcgtggatgtggtccagcctgctctgtttgcggtgatggtgtcgttggcggaggtgtggcgggccgctggtgtgcgtcctgatgcggtgatcggtcactcgcagggcgagatcgctgccgcgtgtgtggcgggcatcttgtcgcttgaggacgcggcgcgagtggtcgcgttgcgcagtcaggcgatcggccgggtcctggcgggcctgggcgggatggtgtccgtggcactgccggcgaaggctgtgcgggagctgatcgctccgtggggcgaggaccggatctcggtggccgcggtgaacgggccttcctccgtggtcgtttccggtgagaccgccgccctggacgagctgctggcctcgtgcgagtcggacggcgtccgggcgaagcggatcgcggtggattacgcgtcgcattcggctcaggtggagttgctgcgtgaggagcttgctgagctgctggctccgattgttccgcgggctgccgaggtgccgttcctgtcgacggtgacgggtgagtgggtgcgcggtccggagctggatggcgggtactggttccagaacctgcgtcggacggtggagttggaagaggcgacgcggacgttgctggagcagggcttcggtgtgttcgtcgagtcgagcccgcaccccgttctgacgatgggtgtgcaggagaccgtcgaggacgcgggccgtgacgcggctgttctgggctcgctgcgtcgtggtgaggggggtctggagcgtttctggctgtcgctgggtgaggcctgggtccgtggcgtgggtgtggactggagtgccgtgttcgcgggcacgggtgcccggcgggtggatctgcccacttacgccttccagtcgcagcggttctggccggaggccgcgcccatcgaggctgtggcggtgtcggcggagagtgcgatcgatgcgcggttctgggaggccgtcgagcgcgaggatctcgaagcgctgaccgctgagctcgacatcgagggcgaccagccgctgaccgcgctgctgcccgcgctgtcgtcgtggcgtcggcagagccgtgagcactcgacggtggacggctggcgctaccgggtcacctggaagccgctggccgaggccaagacctctcgcctctccggtacttggctggtcgtcgttcccgagaacggcccggccgacgagtggacgggggccgtgctgcgcgtgctcgccgaccgcggcgcggaggtccgtactgtgaccgtcccggccgacggggccgatcgtgaccggctcgccgccacgctgaaggccgagacggacggggccgctccggccggagtgctgtccctcctcgcccttgccgtcgaaagcgctgaactccgtacgcacaccgggctcctcgccaccgccgcgctcgtccaggcgcttggtgacgccgatgtggccgcacccctgtggtgcgtcacgcgtggcgctgtctccgtcgcccgtacggagcggctccaggacccggcgcaggcgctcgtgtcgggcttcggacgcacggtcgccctggagtacccggaccgttggggcggtctcgtcgacctgccggagcaggccgacggccgtacgctcgaacgtcttgcgggtgtgctggccggtgacggttccgaggaccaggtggcgctgcgcgcctcgggtctcttcggccggcgtctggtccacgcacccctcgccgacaccgccgcggtacgggagtggcgtccgcagggcacgaccctggtcaccggtggtacgggtgcgctgggcgcgcacgtggcccgctggctcgctgagaacggtgccgagcacttgctgctcaccagccgccggggcccggacgcgcccggtgccgccgaactccgcgacgaactcacggccctcggcgcccaggtcaccatcgccacctgcgacatggccgaccgggacgccgtcgcggccctcatcgccgccgttcccgccgaccagcccctcaccgcggtgatgcacacggccggtgtcctcgacgacggcgtgatcgacgcgttgactccggagcggttcgggacggtgctcgcccccaaggcggacgcggccctcaccctccatgagctgacccgcgagctgggcctctcggcgttcgtcctcttctccggtgtcgcgggcacgctcggcgacgcgggacagggcaactacgccgccgcaaactcctacttggacgccctcgccgagcagcgtcacgccgacggcctcgccgccacctcggtggcctggggtcgctggggcgacagcgggctcgccgcgggcggtgcgatcggtgagcggctcgaccgcggcggggtgcccgccatggcaccccgctcggcgatccgcgcgctgcagctggccctcgaccacgcggaggcggccgtcgccgtcgccgacatccagtgggagcggttcgcgcccggctacacggcggtgcggcccagcccgttcctcggtgacctgccggaggtgcggcagctcgccgcgtccgctccggcggccggtgaagcgggcggggactccccggccgaggcgctgcgccgacggctcgccgtcatgccgcaggccgaacaggccctggccgtcctcgaactggtccgctcccacgcggccaccgcgctgggccaccccacgaccgacgaggtgggcgcgggccgcgcgttcaaggagctcggattcgactccctgatcgcgctggaactgcgcaaccggctcaacgcagccaccgggctgaggctcccggccacgctcgtattcgaccacccgaccccgacgatcctggccgagttcctccgggccgagatcacccaggacggcagtgccggggccgccccgggcatcacggaactcgaaaagctggagtccgcgctgtccgttctcgacccggacagtgaaacgcgtaccgatatcgcactgcgcctgcaggcacttctcgcgaaatggggtgaaccgcacatcgaatcaagtggcgaggccgtgaccgagaaactccaggaggccacgcccgacgaactcttcgaattcatcgagaaagagttcggtatttag

SEQ ID NO: 35 - protein, 7510 aa, Streptomyces aizunensis
MGEVPMADQDKILGYLKRVTADLHQTRQRLREVEAQEPEPIAIVGMSCRFPGGIESPEGLWDLVAGGRDAITDFPTDRGWDIESLYDADPDQQGTSYTREGGFLDGVGKFDASFFGISPRETLGMDPQQRLLLETSWEAFERAGIDAATLRGSKAGVFIGTNGQDYPELLREVPKGVEGYLLTGNAASVVSGRISYTFGLEGPAVTVDTACSASLVALHLAVQALRNDECSLALAGGVTVMSSPRAFVQFSRQRGLAPDGRCKPFADGADGTGWGEGVGMLLVERLSDARRNGHPVLALVRGSAINQDGASNGLTAPNGPSQQRVIRQALTNAGLTPAQVDVVEAHGTGTTLGDPIEAQALLATYGQNRPEGRPLWLGSVKSNIGHTQAAAGVAGIIKMVLAMQHGVLPESLHIDQPSGNVDWAAGDVKLLTEAVPWPQTGQPRRAGVSSFGVSGTNAHTVIEQAPPADDAPETGADTAPTAEAPEAASADASEAGTPTGATGPVPVLVSGQSDAALRAQAERLAAHLRAHPGLGADTGTLTDLGFSLATSRSSLDRRAVLFGDRDSLLADLSALAEGEQPAGPVLGAVGEGKTAFLFTGQGSQRLGMGRELYATHPGFARALDEVRAELDQHLERPLFDVLFAAEGTPEADLLDETAYTQSALFAVEVALFRQLEQWGVGADFLIGHSIGELAAAHVSGVFTLADAAKLVAARGRLMQALPADGAMIAVEATEDEVAPLLTGRVSIAAVNGPRSVVVSGDEDAATALAETLRARGRRTKRLTVSHAFHSPLMDGMLDAFREVAESVAYAPPVIPIVSNLTGASVTAEEICAADYWVRHVREAVRFLDGVRKLSAQGVTTFVEVGPGGVLTALAQECVTGQDAVFVPVLRGDRPEAAAFATAVAQAHVHGVAVDWSAVFAGRGATRIDLPTYAFQRELYWPEQPTAWAGDVTAAGIGAADHPLLGAAIALADGDGHLFTGRLSLATHPWLADHTVMDTVLLPGTAFVELALQAGDHTGCDLLDELTLEAPLVLPPHGGVQIQLAVGAPDAEGRRSLTLHSRPEDAADDTWGEGAWTRHATGFLATAAQGAREPLADLTSWPPKNATKVDVEGLYAYLTESGFAYGPVFQGLTGAWQRGDEVFAEVRLPEQAHAEAALFGLHPALLDAALHAVGIGSLLEDTEHGRLPFSWSGVSLRAVGARALRVRLAPAGNDTVSVTLADETGAPVAAVDALLLRPVSPDQVHAARTAFHDSLFRVEWTGTPLPAATTVAAGQWALLGEPRTEFTAALPTAATHADLAALGAALDAGGPVPRAVIVPFSASGAPSATPVDAALPTAVADALHRTLELAQAWLADDRFAGSRLVFVTRDAVATTAGSDVADLAHAPLWGLLRSAQSEHPDRFVLLDLDGREDSLRALPAALATAEPQLALRAGKALVPRLARVAAAPGQEAPALDPDGTALVTGATGTLGGLVARHLVAAHGVRHLLLTSRRGEAAAGAAELAAGLRELGAEVTIAACDAADRDALAALIGSVPAEHPLTAVVHTAGVLDDGVLEALTPERIDAVLPAKVDAAVHLHELTRELDLAAFVLFSAAAGTLGGPGQANYAAANTFLDALAHRRRAEGLPATALAWGLWAERSGMTGDLADADLERISRAGVAALSSAEGLALLDTARAVGDPTAVPMHLDLASLRHADASMVPALLRGLVRAPARRSVESPGAAPAGGLAERLLPLTAAERDRLLLDTVRVQVAAVLGYPGPEAVDPGRAFKELGFDSLTAVELRNRLGSATGVRLPATLVFDYPTPNALSAFLRTELLGDAADSAPVAAVTARDDEPIAIVGMSCRYPGGVTTPEELWQLVAGSVDAISPFPTDRGWNLDALYDADPGRAGTSYTREGGFLHDAADFDPDVFGINPREALAMDPHQRLLLETSWEAFEQAGIAPSSMRGSRTGVFAGVMYHDYLTRLPAVPEGLEGYLGTGTAGSVASGRISYTFGLEGPAVTVDTACSSSLVALHLAAQALRNGECDMALAGGVTVMSTPDTFIDFSRQRGLSGNGRCKSFSADADGTGWAEGAGMILVERLSDARRNGHQVLAVVRGTAVNQDGASNGLTAPNGPSQQRVIRQALANAGLTTAEVDVVEAHGTGTTLGDPIEAQALLATYGQDRPAGQPLRLGSIKSNIGHTQAAAGAAGIIKMILAMRHGVMPPSLHIGEPSPHIDWTAGAVSLLTEAAEWPDAGRPRRAGISSFGVSGTNAHVIIEQPPVEEPATATETGSGTGLPAGTPLPFALSGRTPAALRAQAARLIGHLAPRPEAAPADVALSLATTRTALDRRAAVIAHDRTELLAGLTALAEGHDSARLVQHTAADGRTAILFTGQGSQRPGMGRELYETYPAFAEALDAVCAELDPHLEQPLKEVLFTADGDLLNRTGRTQPALFALETALYRLVESWGVRPDFVAGHSIGEITAAHVAGVLSLPDAATLVAARGRLMQELPEGGAMIALTATEDEVLPLLAGHEDRIGIAAVNSASSVVISGEEGLALEIAAEFERRGRRTKRLTVSHAFHSPLMDGMLDAFREVAESLTYRAPAIPVVTLLTGTVAGDELRTAEHWVSHVREAVRFLDGIRTLDAEHVTTYLELGPQGVLSGLGRDCLTDPADPADTAVFVPALRRDRGEAEALTAAIAAAHTRGVPLDWSAYFAGTGARRVELPTYAFQRERFWLEAPAGYIGDVESAGMGAAHHPLLGAAVALADGEGFLFTGRLSLDTHPWLADHAVMGNVLLPGTAFVELAIRAGDQAGCDLLEELTLEAPLILAPQAAARLQIVVGAPDGSGRRTLDVYSSDPDAPADEPWTRHAGGILATGAQAPAFDLTAWPPPGAEAVGVDGLYEHLGRGGFAYGPVFQGLRAAWLLGDDVYAEVALPDDRQAEAARFGLHPALLDAALHATFVQPSPDGDQQGRLPFSWRDVSLHAVGASALRVRLTPDGRDTLSLQLADTTGAPVAAVGHLTLRPVSADQLGSARSAHHESLFRIDWATVPLPSDAPAATDEWAVIAADGGTDGGTDGGTDGGIPAALPGRVHTGLDALGAAVDAGAPVPAHVLVHHTPAATTADAVHAATHEALRLVRAWLADDRFAASRLVFVTRGAIATQSDWDLTDLTHAPVWGLVRTAQSENPDRFVLADLDADPASTDALAAALATGEPQLAVRRGTVHAPRLARVPAATPLTPPPGESAWRMDIEDKGTLDHLTLVPSPESAAPLEPGQVRVAVRAAGLNFRDVLNALGMYPGDPGLMGSEGAGIVVETGPGVTGLAPGDRVMGMLPGSFGPLAVVDRRMIAPMPEGWTFAEAASVPIVFMTAYYALHDLAGLQGGESLLVHAAAGGVGMAAVQLARHWGADVYATASPAKWDTLRGLGLGDDRIASSRTLDFEETFRTATGGRGVDVVLDSLAREFVDASLRLLPRGGRFVEMGKTDVRSPQDVADAHPGVSYQAFDLTEAGLDRIQEMLTELLTLFRSGALRPVPVSAWDLRQAPEAFRYLSQARHVGKIVLTLPGEWNSQGTVLITGGTGTLGAVVARHAVTTRGARRLLLTSRRGEAAAGAAELAAELRELGAEVTIAACDAADRDALAALIESIPSEHPLTAVIHTAGVLDDGVVDSLTPERLSTVLRPKVDAAWNLHELTRHLDLADFVLFSSAAGTFGGAGQANYAAANVFLDALARHRHAHGLAATSLAWGLWAEASGMTGELDTADKDRMTRSGVLGLSSEEGVALLDTARLTGDALLVPMHLDLAPLRRTDASMVPALLRGLVRAPARRAVGATAAGAGTPLVERLVRLPENERDPLLLDLVRQQVAAVLGHATPDAVEPTRAFKDLGFDSLTAVEFRNRLGATAGIRLPATLVFDYPTPTVLAGYLKDELLGSEAAAALPKLAATAVEGDDPIAIVAMSCRFPGDVRTPEDLWELLAEGRDGISDLPDDRGWDTEALYDPDPDSPGTSYAREGGFFYDAHHFDPAFFGINPREALAMDPQQRLLLETSWEAFERAGIDPTGLRGKQVGVFVGQMHNDYVSRLNTVPEGVEGYLGTGGSSSIASGRVSYTFDFEGPAVTVDTACSSSLVALHLAAQALRNGECTLALAGGVTIITTPDVFTEFSRQRGLASDGRCKPFAEAADGTAWGEGVGMLLVERLSDARRNGHQVLAVVRGTAVNQDGASNGLTAPNGPSQQRVIRQALANAGLTAAEVDAVEAHGTGTRLGDPIEAQALLATYGQDRPEGSPLWLGSIKSNFGHTQAAAGVAGIIKMVQAMHHGVLPKTLHVDAPSPHVDWSAGAVSLLTEQMAWPETGRPRRAGVSSFGMSGTNAHAIIELAPDAATPSAARPEPAPAALPWNLSARTPDALRAQGERLLSHLETHCETHPETVLADIGHSLTTGRALFEHRATVVAGDRDGFRAGLAALAEGRTAAGLIQGSSSTGGRTAFLFTGQGSQRLGMGRELYEAYPVFARALDEVCARLELPLPLKDVLFGTDTGLLNETAYTQPALFAVEVALFRLVESWGLKPDFLAGHSIGEIAAAHVAGVLSLEDACALVSARGRLMGALPGGGVMIAVQASEGEVLPLLTDRVSIAAINGPQSVVIAGDEADAVAIVESFSDRKSKRLTVSHAFHSPHMDGMLDDFRAVAEGLSYGAPRIPVVSNLTGALVSDEMGSADFWVRHVREAVRFLDGIRALEAAGVTTYIELGPDGILSAMAQECITGEGAAFAPVLRAGRDEAETVLSALAAAHVRGVPVDWQAFYAPAGAQRVPLPTYAFQRSVYWLDAGRAQGDIASAGLGATDHPLLSAAVELPDSDGFLFTGRLSLATHPWLADHAVLGSVLLPGTAFVELALRAGDQVGCDLIDELTLEAPLVLPPHGGVQLRLAVAAADATGRRTLAFHSRSEDADAGTPWTRHASGVLAVGAERTPQSLTEWPPTGAESVPVDGLYEGLAESGFGYGPVFQGLRAAWRRDGEYYAEVALPEGTEDEAGRFGLHPALLDAALHALGLGSTDTEGGEGRLPFSWSGVHLHAVGASALRVRLTTSRSGEVALTIADAAGEPVATVAGLALRAVSREQLSTARDLTRDALFRVDWTALPAGGAVGSLDDWMLLGAGSQVYADLAGLGVAVAEGGGIPAALVVPVSEPDAESAAGGVAGTVHAAVERALSLVQEWLSDERFADARLVFLTRGAVAARAGDTVPGLVQAAVWGLVRSAQSENPGRFALIDVDGDGDGDGEVDGDVLSAALATGEPELAVREGALLVPRLARAAVVEGAGRELDVDGTVLVTGASGTLGGLFARHLVVERGVRRLLLVSRRGEAAEGAAELGAELTELGADVRWAACDVADRDALEAVLAGIPAEYPLSGVVHTAGVLDDGVVSSLTPERLSAVLRPKVDAAWNLHELTRGLDLSLFVLFSSAAGVFGGAGQANYAAANVFLDALAQHRRAQGLAATSLAWGLWAGVGGMGGELTESDRERINRGGITALEPETGLALFDAAQRTTDALLVPLPLDLAALRVQAGSGMLPDLLRGLVRVPVRRAAGQGSAAGGGSVLRTRLAAMPADERDAALLDLVRAEVAAVLGHASTDEVPADRAFKELGFDSLTSVELRNRLGATTGERLSATLVFDYPTPHALAEFLRTEVLGLDEPTDTATTAPTHLGTSLDDDPIAIVGMSCRYPGGVETPEDLWRLVVGGGDAISEFPQGRGWDLESLYDPDPDGKGTSYTRSGGFLHDAGRFDPAFFGISPREAVAMDPQQRLLLETSWEAFERAGIDPASMRGSRTGVFAGIMYHDYATRITSVPDGVEGYLGTGNSGSIASGRVSYAFGLEGPAVTVDTACSSSLVALHWAIQALRNGECTMALAGGVTVMSTPGTFTEFSRQRGLAADGRIKSFAAAADGTSWAEGAGMLLVERLSEARAKGHPVLAIVRGSAINQDGASNGLTAPNGPSQQRVIRQALAGARLTSDQIDVVEAHGTGTTLGDPIEAQALLATYGREREADQPLWLGSIKSNMGHTQAAAGVAGIIKMIMAIRHGVLPKTLHVDEPTPHVDWEAGAVSLLTESVPWPETGRPRRAGVSSFGISGTNAHTIIEQAPEEFVPVRVTESQTPGAGSRVLPFVLSAKSAGALRGQAVRLKAHVEASPEVSGAGAVDVAYSLATRRAVFDHRAVVVAGDREELLRSLAAVESEGAAAGVTRGAVGGGKLAFLFTGQGSQRLGMGRELYETYPVFARALDAACARLELPLKDALFGTDAGLLGETAYTQPALFAVEVALFRLLESWGVRPDFLAGHSIGEIAAAHVAGVLSLDDACALVEARGRLMQALPTGGVMIAVQASEAEVLPLLTDRVSIAAINGPQSVVIAGDEADAVAIVESFSGRKSKRLTVSHAFHSPHMDGMLAGFRKVAESLSYEAPRIPVVSNLTGALVTDEMGSADFWVRHVREAVRFLDGIRTLEAAGVATYVELGPDGVLSAMAQDCVTGEGAAFAPALRKGRPETETITTALALAHAHGTSVDWETYFAGTGAQGVELPTYAFQRDWYWLNSAVVQAGPGDASGFGLGATDHPLLDATIELPDSDGFLFTSRLSLDTQPWLADHAVLGSVLLPGTAFVEIAVRAGDQVGCDVLEELTLEAPLVVPERGGVQLRLTVAAADESGRRGLSLYSRDEDAPADEPWTRHASGVLATGAAAPDFDLAAWPPAGAEPVDIDGLYEGLAAAGFDYGPAFQGLRTAWLHGDAVYAEVSLDEESAESAEWFGLHPALLDATLHAAGLGGLVESTGQGRLPFAWSNVSLHAAGASAVRVRLAPAGRDAVSLQLADAAGAPVASVESLVLRAVSPDQIGAARGGRHESLFEIDWAALPLAPVSAAEQRPWALLADDGSGHAGLEAVGVRHEAHTGLAALADTGRAIPEVVCVPLAAANSQDLAGAGAVHAAVERALGLVQEWLSDERFADARLVFLTRGAVSAVPGEDVTDLVHAPVWGLVRSAQSENPGRFVLADTDGTDASYRALTAALASGEPEFTVRGGAVRVPRLTRSTAVAVEAVPELGSDGTVLVTGASGTLGGLFARHLVVERGVRRLLLVSRRGGAAEGAAELGAELTELGADVRWAACDVADRDALESVLAGIPAEYPLSGVVHTAGVLDDGVVSSLTPERLSAVLRPKVDAAWNLHELTRGLDLSFFLLFSSAAGVFGGAGQANYAAANVFLDALAQHRRAQGLAATSLAWGLWAEPGGMAGALDADDVSRLGRGGVSGLSAQEGVALFDAASASEQALFVPVKLDLAALRAQAGSGMLPPLLSGLVRTPTRRAAGTGGTGDTGTDGGTALRERLAGLAPAARDEALLELVCTYVAAVLGFAGPEAVDPARSFSEVGFDSLTAVELRNRLGAATGVRLPATLVFDYPTPDALVEYLRDELWQDGAAAVPPLLAELDRLEKTLVASVPDDDGRTRITERLQALLAAWSEAGESTDTADADVAEALETATDDDLFDFIGKEFGIS

SEQ ID NO: 36 - DNA, 22533 bp, Streptomyces aizunensis
atgggtgaggttccaatggcagatcaggacaagatcctcggttacctgaagcgggtgacggccgatctgcaccagacgcgccagcgccttcgtgaggtcgaggcccaggagccggagccgatcgcgatcgtcggcatgagctgcaggttccccggcggcatcgagtcgccggagggcctgtgggacctggtggccggtgggcgggacgcgatcaccgatttccccaccgaccgtggctgggacatcgagtcgctgtacgacgccgaccccgaccagcagggcacctcgtacacccgtgagggcggattcctcgacggcgtcgggaagttcgacgcgtccttcttcgggatcagcccgcgcgaaaccctcggcatggacccgcagcagcgcctgctcctcgaaacgtcctgggaagccttcgaaagagccggaatcgacgcggctaccctgcgcggcagcaaggccggtgtcttcataggcaccaacggccaggactatccggagctgctgcgcgaagtccccaagggtgtcgagggatatctcctcaccggaaacgcggccagcgtcgtctccggccgcatttcctacaccttcggcctcgaaggcccggccgtcaccgtcgacaccgcctgctcggcctcgctcgtcgccctgcacctcgccgtccaggcgctgcgcaacgacgagtgctcgctggcgctggcgggcggtgtcaccgtgatgtcgagcccgcgcgcgttcgtacagttcagccgccagcgcgggctcgcgcccgacggacgctgcaagccgttcgccgacggggccgacggcaccggctggggcgagggcgtcggcatgctgctcgtcgagcggctctccgacgcccgcaggaacggtcatcccgtcctcgccctcgtgcgcggctcggcgatcaaccaggacggcgcgagcaacggcctgaccgcgcccaacggcccgtcccagcagcgggtgatccggcaggcgctcacgaacgccgggctcacccccgcgcaggtcgacgtcgtcgaggcgcacggcaccggtacgaccctcggcgacccgatcgaggcgcaggccctgctcgccacgtacggccagaaccgccccgaggggcgcccgctgtggctgggttccgtcaagtcgaacatcgggcacacgcaggccgccgccggtgtcgcgggcatcatcaagatggtcctcgccatgcagcacggcgtgctgcccgagtcgctccacatcgaccagccgtccggcaacgtcgactgggccgccggtgacgtcaagctgctcaccgaggccgtgccgtggccgcagaccggccagccgcgccgcgccggcgtctcctccttcggcgtcagcggcaccaacgcgcacaccgtcatcgagcaggccccgcccgccgacgacgcgccggagaccggcgcggacaccgcacccaccgccgaggcgccggaggcggcctccgcggacgcttccgaggccgggacgccgaccggtgccaccggcccggtgccggtgctcgtctcgggccagagcgacgccgcactgcgcgcccaggccgagcgcctcgccgcccacctgcgcgcccaccccggactcggggccgacaccggaaccctgaccgacctcggtttctcgctcgccaccagccgctcctcgctcgaccgcagggccgtcctgttcggcgaccgggacagcctgctcgccgacctcagcgccctcgccgagggcgagcagcccgccggcccggtcctcggcgcggtgggcgagggcaagaccgccttcctcttcaccggccagggcagccagcgcctgggcatgggacgcgagctgtacgccacgcatcccggcttcgcccgcgccctcgacgaggtccgcgcggaactggaccagcacctcgaacgccccctgttcgacgtcctgttcgccgccgaaggcacccccgaggcggacctgctcgacgagaccgcctacacccagagcgccctgttcgccgtcgaggtcgccctgttccggcagctcgaacagtggggcgtcggcgccgacttcctcatcggccactccatcggcgaactcgccgccgcccacgtctccggcgtgttcaccctcgccgacgcggccaagctcgtcgccgcccgcggccgcctcatgcaggcgctgcccgccgacggcgcgatgatcgccgtcgaggccaccgaggacgaggtcgcaccgctgctcaccggccgggtgagcatcgccgccgtcaacggcccccgctccgtggtcgtctcgggcgacgaggacgccgccacggcgctcgccgagaccctgcgcgcacggggccgcaggacgaagcggctcacggtcagccacgccttccactcgccgctgatggacggcatgctcgacgcgttccgtgaggtcgccgagagcgtcgcctacgcgccgcccgtcatcccgatcgtctccaacctgaccggcgcctccgtcaccgcggaggagatctgcgccgccgactactgggtgcgccacgtccgcgaggccgtccgcttcctcgacggagtccgcaagctctccgcgcagggcgtcaccaccttcgtcgaggtgggaccgggcggggtcctcaccgccctggcgcaggagtgcgtcaccggccaggacgccgtcttcgtgcccgtcctgcgcggtgaccgccccgaggcggccgccttcgcgacggccgtcgcccaggcccatgtccacggtgtggccgtcgactggtccgccgtcttcgccgggcgcggagccacccgcatcgacctgccgacgtacgccttccagcgcgagctgtactggcccgagcagcccaccgcctgggcgggcgacgtcaccgccgccgggatcggcgccgccgaccacccgctgctgggcgcggccatcgccctggccgacggcgacgggcacctgttcaccgggcggctctcgctggccacccacccctggctcgccgaccacacggtgatggacaccgtgctgctgcccggcaccgccttcgtcgaactcgccctccaggcgggcgaccacaccggctgcgacctgctggacgaactcaccctggaagcaccgctggtgctgcccccgcacggcggggtgcagatccagctcgccgtgggcgcgcccgacgccgagggccgccgctcgctgacactgcactcccggcccgaggacgccgccgacgacacctggggagagggcgcctggacgcgccacgccaccggcttcctcgccaccgccgcccagggcgcccgcgagcccctcgccgacctcaccagctggccgccgaagaacgccacgaaggtcgacgtagaaggcctgtacgcgtacctcaccgagtccggcttcgcctacggtccggtcttccagggcctgaccggcgcctggcagcgcggcgacgaggtcttcgccgaggtccgcctgccggagcaggcgcacgccgaggccgccctgttcggtctgcatcccgcgctgctggacgccgcgctgcacgccgtcggcatcggctccctcctggaggacaccgaacacggcaggctgccgttctcctggagcggagtctccctgcgggcggtcggcgcccgtgccctgcgcgtccggctcgcccccgcaggcaacgacaccgtgtcggtgaccctcgccgacgagaccggagcgcccgtcgccgccgtcgacgcgctgctgctgcggcccgtctccccggaccaggtgcacgccgcccgcaccgccttccacgactcgctgttccgcgtggagtggaccggtacgcccctcccggccgccaccaccgtcgccgcgggccagtgggcgctgctgggcgagccccgtacggagttcaccgccgcgctgcccaccgccgccacccacgccgacctcgccgccctcggcgcggcgctggacgcgggcggcccggtcccgcgggccgtcatcgtcccgttctccgcgtccggcgccccctcggcgactcccgtcgacgccgcgctgcccaccgccgtcgccgacgccctgcaccgcaccctggagctcgcccaggcgtggctcgccgacgaccggttcgccggctcccggctcgtgttcgtcacccgcgacgccgtcgccaccaccgccggatccgatgtcgccgacctggcccacgccccgctgtggggtctgctgcgctccgcgcagtccgagcaccccgaccggttcgtcctgctggacctggacggacgcgaggactccctgcgggccctgcccgccgcgctcgccacggccgagccgcagctcgccctgcgcgcgggcaaggccctcgtgccccggctcgcccgggtcgccgccgcccccggccaggaggcgcccgcgctcgaccccgacggcaccgccctggtcaccggcgccaccggcaccctcggcggcctggtcgcccgccacctcgtcgccgcgcacggcgtccgccacctgctgctgaccagccggcgcggcgaggccgccgccggcgccgccgaactcgccgccggactgcgggaactgggcgccgaggtcaccatcgcggcctgtgacgccgccgaccgcgacgcgctcgccgcgctcatcgggtccgtaccggccgaacacccgctcaccgccgtcgtccacaccgccggagtcctcgacgacggcgtcctcgaagcgctcacccccgagcgcatcgacgccgtcctgcccgccaaggtcgacgcggccgtgcacctgcacgagctgacccgcgagctggacctcgcggccttcgtcctgttctccgccgccgccggcaccctcggcggccccggacaggccaactacgccgccgccaacaccttcctcgacgcgctcgcccaccggcgccgcgccgaaggactgcccgccaccgccctcgcctggggcctgtgggccgaacgcagcggcatgaccggcgacctcgccgacgccgacctggagcggatctcccgcgccggagtcgccgccctgtcgtccgccgagggcctggcgctgctggacaccgcccgcgccgtgggcgaccccaccgccgtccccatgcacctcgacctggcgtccctgcgccacgccgacgcgagcatggtccccgcgctgctgcgcggcctggtccgcgcgcccgcccgcaggtccgtcgagtccccgggcgccgccccggccggcggcctcgccgagcgcctgctgcccctgaccgccgccgagcgcgaccggctgctcctggacaccgtccgggtccaggtcgccgccgtcctcggctaccccggccccgaggccgtcgacccgggccgtgccttcaaggaactcggcttcgactcgctgaccgccgtagagctgcgcaaccgcctcggctccgccaccggcgtacggctgcccgccaccctcgtcttcgactaccccaccccgaacgcgctctccgcgttcctgcggaccgaactcctcggcgacgccgcggactcggccccggtcgcggccgtcaccgcccgtgacgacgagcccatcgccatcgtcggcatgagctgccgctaccccggcggggtcaccacccccgaggagctgtggcagctcgtcgccggctccgtcgacgcgatctcgcccttccccacggaccgcggctggaacctcgacgcgctgtacgacgccgaccccggccgggccgggacctcgtacacccgggagggcggcttcctgcacgacgccgccgacttcgacccggacgtcttcggcatcaacccgcgcgaagccctcgccatggacccgcaccagcggctcctcctggagacgtcctgggaggcgttcgagcaggccgggatcgccccctcgtccatgcgcggcagccgcaccggcgtgttcgccggcgtcatgtaccacgactacctgacccggctcccggccgtgcccgagggcctggagggctacctcggcaccggcaccgcgggcagcgtcgcctccggccgcatctcgtacaccttcggcctcgaaggccccgccgtcaccgtcgacacggcctgctcctcctcgctggtcgccctgcacctcgcggcccaggccctgcgcaacggcgaatgcgacatggccctcgcgggcggtgtcaccgtcatgtccaccccggacaccttcatcgacttcagccgccagcgcggcctctccggcaacggccgctgcaagtccttctccgccgacgccgacggaaccggctgggccgagggcgcgggcatgatcctcgtcgagcggctctccgacgcccgccgcaacggccaccaggtcctggcggtcgtccgcggcaccgccgtcaaccaggacggcgccagcaacggcctgaccgccccgaacggcccctcccagcagcgcgtcatccgccaggccctcgccaacgcgggcctgaccaccgccgaggtcgacgtcgtcgaggcgcacggcaccggcaccaccctcggcgaccccatcgaggcgcaggccctcctcgccacctacggccaggaccgcccggccgggcagccgctgcggctcggctccatcaagtccaacatcggccacacccaggccgcggcgggcgcggcgggcatcatcaagatgatcctcgccatgcgccacggcgtcatgccgccgtcgctgcacatcggcgagccgtccccgcacatcgactggaccgcgggcgcggtctcgctgctcaccgaggccgccgagtggcccgacgcgggccgcccccgccgcgcgggcatctcctccttcggcgtcagcggcaccaacgcccacgtcatcatcgagcagccgcccgtcgaggaacccgccaccgcgaccgagaccggctccggcaccggcctgcccgccggcacgcccctgccgttcgccctctccggccggacccccgccgcgctgcgcgcccaggccgcccggctgatcggccacctcgcgccgcggcccgaggccgcccccgccgatgtggcgctctcgctggccaccacccgtaccgccctggaccgcagggccgccgtcatcgcgcacgaccgcaccgagctcctcgccgggctcaccgccctggccgagggccacgacagcgcccggctggtccagcacaccgccgccgacggccgcaccgcgatcctgttcaccggacagggcagccagcgccccggcatgggacgcgagctgtacgagacgtaccccgccttcgccgaggcgctggacgcggtctgcgccgagctggacccgcacctcgaacagcccctcaaggaggtcctgttcaccgccgacggcgacctgctgaaccggaccggccgcacccagcccgccctgttcgcgctggagaccgccctgtaccggctcgtcgaatcgtggggcgtgcgccccgacttcgtcgccgggcactccatcggcgagatcaccgccgcgcacgtcgcgggcgtcctctccctgcccgacgcggccaccctggtcgccgcccgcggccgcctcatgcaggaactgcccgagggcggcgcgatgatcgcgctcaccgccaccgaggacgaggtcctgccgctgctggccggccacgaggaccgcatcggcatcgccgccgtcaactcagcctcctccgtggtcatttccggcgaggagggcctcgcgctggagatcgccgccgagttcgagcggcgcggtcggcgcaccaagcggctcaccgtcagccacgccttccactcgccgctgatggacggcatgctcgacgccttccgcgaggtcgccgagtccctgacctaccgggcgcccgccatcccggtcgtcacgctcctcacgggaacggtcgccggggacgaactgcgcaccgccgagcactgggtctcccacgtccgcgaggcggtccgcttcctcgacggcatccgcaccctggacgccgagcacgtcaccacctacctcgaactcggcccgcagggcgtgctgtccggcctcggccgcgactgcctcaccgaccccgccgacccggccgacaccgccgtcttcgtaccggcgctgcgccgcgaccgcggcgaggccgaagccctgaccgccgcgatcgccgcggcccacacccgcggtgtgccgctcgactggtccgcgtacttcgcgggcaccggcgcccgccgcgtcgaactgcccacctacgccttccagcgcgagcggttctggctcgaagccccggccggctacatcggcgacgtcgaatcggcgggcatgggcgcggcccaccacccgctgctcggcgccgccgtcgccctcgccgacggcgaaggattcctgttcaccggccggctctcgctcgacacccacccctggctcgccgaccacgccgtcatgggcaacgtcctgctgccgggcaccgccttcgtcgaactcgccatccgcgcgggcgaccaggccggctgcgacctcctcgaagaactcaccctcgaagcaccgctgatcctcgccccgcaggccgcggcacgcctccagatcgtggtcggagcccccgacgggtccggccgccgcaccctggacgtgtactccagcgacccggacgcccccgccgacgagccgtggacccgccacgccggcggcatcctcgccaccggggcacaggcacccgccttcgacctgaccgcgtggcccccgccgggcgccgaagccgtcggcgtcgacggcctctacgaacacctcggccggggcggcttcgcctacggtcccgtcttccaggggctgcgcgccgcctggctcctcggcgacgacgtgtacgccgaggtcgccctgcccgacgaccggcaggccgaggccgcccggttcggcctgcacccggcgctcctcgacgcggccctgcacgccaccttcgtccagccgtcccccgacggggaccagcagggccggctgccgttctcctggcgcgatgtgtccctgcacgccgtcggtgcgtccgcgctgcgcgtccgcctcacccccgacggccgggacaccctctccctccagctcgctgacaccaccggcgctcccgtcgccgccgtcggccacctgacgctgcggcccgtctccgccgaccagctcggcagcgcacgctccgcacaccacgagtccctgttccggatcgactgggccaccgtgccgctgccgtccgacgcccccgccgccacggacgagtgggccgtcatagccgcggacggaggcacggacggcggtacggacggaggcacggacggcggcatccccgccgccctccccgggcgcgtgcacaccggcctggacgccctcggcgcggcagtcgacgcgggcgccccggtgcccgcccacgtcctggtgcaccacacccccgcggccaccaccgccgacgccgtccacgcggccacccacgaggcgctccgcctcgtccgggcctggctcgccgacgaccggttcgccgcgtcccgcctggtcttcgtcacccgcggcgcgatcgccacgcagagcgactgggacctcaccgacctgacccacgcccccgtgtggggactggtgcgcaccgcccagtccgagaaccccgaccggttcgtcctcgccgacctcgacgccgacccggcctcgacggacgccctcgccgcagccctcgccaccggcgagccgcagctcgcggtccgccgtggcaccgtccacgccccccgcctcgcccgcgtccccgccgccaccccgctgaccccgcccccgggcgagtccgcctggcgcatggacatcgaggacaagggaacgctcgaccacctcaccctcgtccccagcccggagtccgccgcgcccctggagcccggccaggtccgcgtcgccgtccgcgccgcgggcctcaacttccgcgatgtgctcaacgccctcggcatgtaccccggcgacccgggcctcatgggcagcgaaggcgccggcatcgtcgtggagacgggccccggtgtcaccggcctcgcacccggcgaccgcgtcatgggcatgctgcccggctcgttcggcccgctcgcggtcgtcgaccgccgcatgatcgcccccatgcccgagggctggaccttcgccgaggccgcgtccgtacccatcgtcttcatgacggcgtactacgccctccacgacctcgccggactgcagggcggcgagtccctcctcgtgcacgccgccgccggtggcgtcggcatggccgccgtccagctcgcccgccactggggcgccgacgtctacgcgacggccagccccgccaagtgggacaccctgcgcggactcggcctcggcgacgaccggatcgcctcgtcccgcaccctcgacttcgaggagaccttccgcacggccaccgggggacgcggcgtcgacgtcgtactcgactcgctggcccgggagttcgtcgacgcctccctgcggctcctgccgcgcggcggacgcttcgtcgaaatgggcaagaccgacgtccgctccccgcaggacgtcgccgacgcccacccgggcgtcagctaccaggcgttcgacctgaccgaggccggcctcgaccgcatccaggagatgctcaccgagctgctcaccctcttccgctccggcgccctgcgccccgtaccggtctccgcatgggacctgcggcaggcccccgaggcgttccgctacctcagccaggcacgccacgtcggcaagatcgtgctcaccctgccgggcgagtggaactcgcagggcaccgtcctcatcaccggcggcaccggcaccctcggcgcggtggtcgcccggcacgccgtcaccacccgcggcgcccgccgcctgctgctcaccagtcggcgcggcgaggccgccgccggcgccgccgaactcgccgccgaactgcgggaactgggcgccgaggtcacgatcgcggcctgcgacgccgccgaccgcgacgcgctcgccgcgctcatcgaatccataccgtcagagcacccgctgacggccgtcatccacaccgccggagtcctcgacgacggcgtcgtcgactcgctgacccccgagcgcctgtccacggtcctgcgcccgaaggtggacgccgcctggaacctgcacgagctgacccgtcacctcgacctggccgacttcgtcctgttctcctccgccgccggcaccttcggcggcgccggacaggccaactacgcggccgcgaacgtcttcctggacgccctcgcccgccaccggcacgcccacggcctcgccgccacctccctggcctggggcctgtgggccgaggccagcggcatgaccggcgaactcgacaccgccgacaaggaccggatgacgcgctccggcgtcctcggcctctcctccgaagagggcgtggcgctgctcgacaccgcacggctcaccggcgacgccctcctcgtccccatgcacctcgacctggcgccgctgcgccggaccgacgccagcatggtccccgccctgctgcgcggcctggtccgcgcccccgcccgcagggccgtcggagccaccgccgccggcgccggaaccccgctggtggagcggctcgtacggctccccgagaacgagcgcgacccgctcctgctcgacctcgtacgccagcaggtggccgccgtactcggccacgccacccccgacgccgtcgaacccacccgcgcgttcaaggacctcggcttcgactcgctgaccgccgtggagttccgcaaccggctcggcgcgaccgccggcatccggctgcccgccacgctcgtcttcgactaccccacccccacggtcctggccggctacctcaaggacgaactcctcggctccgaggccgcggccgccctcccgaagctcgccgccaccgccgtcgagggcgacgaccccatcgccatcgtcgccatgagctgccgcttccccggtgacgtccgcactcccgaggacctgtgggagctgctcgccgagggccgcgacggcatctccgacctcccggacgaccgcggctgggacaccgaggcgctgtacgaccccgaccccgacagccccggcacctcctatgccagggagggcggattcttctacgacgcccaccacttcgacccggcgttcttcgggatcaacccgcgcgaggccctcgccatggacccgcagcagcgcctgctgctggagacgtcctgggaggcgttcgagcgggccgggatcgacccgacgggcctgcgcggcaagcaggtcggcgtcttcgtcggccagatgcacaacgactacgtgtcccggctgaacaccgtccccgaaggcgtcgagggctacctcggcaccggcggctccagcagcatcgcctccggccgcgtctcctacaccttcgacttcgaaggccccgccgtcaccgtcgacacggcctgctcctcgtcgctggtcgccctgcacctcgcggcccaggccctgcgcaacggcgagtgcacgctggccctcgcgggcggcgtcaccatcatcaccacccccgacgtcttcaccgagttcagccgccagcgcggcctcgccagcgacggccgctgcaagccgttcgccgaggccgccgacggcacggcgtggggagagggcgtcggcatgctgctcgtcgagcggctctcggacgcccgccgcaacggccaccaggtcctggcggtcgtccgcggcaccgccgtcaaccaggacggcgccagcaacggcctgaccgccccgaacggcccttcccagcagcgcgtcatccgccaggccctcgccaacgcgggcctgaccgccgccgaggtggacgcggtcgaggcacacggcacgggcacccggctcggcgacccgatcgaggcgcaggcgctgctcgcgacctacggtcaggaccgccccgagggcagccccctgtggctgggctccatcaagtccaacttcggtcacacgcaggccgccgccggtgtcgccgggatcatcaagatggtccaggcgatgcaccacggggtgctgccgaagaccctgcacgtcgacgcgccgtccccgcacgtggactggtcggcgggcgcggtctcgctcctcaccgagcagatggcctggcccgaaaccggccgcccgcgccgcgcgggtgtgtcgtcgttcggcatgagcggtacgaacgcccacgccatcatcgaactcgccccggacgccgccaccccgagtgccgcccggccggagccggccccggccgccctcccgtggaacctctcggcccgcaccccggacgccctgcgcgcccagggcgagcggctgctgtcccacctggagacccactgtgagacccacccggagacggtgctcgccgacatcggccactcgctgacgaccggccgtgccctcttcgagcaccgcgcgacggtggtggcgggcgaccgcgacggcttccgcgccggactggccgcactcgccgaaggccggacggcggcgggcctgatccagggctcgtcctcgaccggcggtcgcacggcgttcctgttcacggggcaggggagccagcggctggggatggggcgcgagctgtacgaggcgtatcccgttttcgcgcgggctctggacgaggtgtgtgcccgtctggaactgcctctgcctctgaaggatgtgctgttcggtactgacacgggtctgctgaacgagaccgcgtacacccagccggcgctgttcgccgtcgaggtggcgctgttccggctggtggagagctggggcctgaagccggacttcctggcgggtcattcgattggtgagatcgctgctgcgcatgtggcgggggtgctctcgctggaggatgcctgtgctctggtgtcggctcgcgggcggttgatgggtgcgctgcctggtggtggcgtgatgatcgcggtgcaggcgtcggagggcgaggtcctgccgctgctgaccgaccgggtgagtatcgccgcgatcaacggtccgcagtcggtcgtgatcgcgggtgacgaggccgacgcggtcgcgatcgtggagtccttctcggaccgcaagtccaagcggctcacggtgagccacgcgttccactcgccgcacatggacggcatgttggacgacttccgggccgtggcggaaggcctgtcctacggggccccgcgcatcccggtcgtttcgaacctcaccggggccctggtctcggatgagatgggttcggcggacttctgggtccggcacgtccgtgaggccgttcgcttcctggatggcatccgcgccctggaggccgcgggcgtcacgacatacatcgagctgggccccgacggcatcctgtcggcgatggcccaggagtgcatcaccggcgagggtgcggccttcgcgcccgtcctgcgggcgggacgcgacgaggccgagacggtgctctccgcgctcgcggcggctcacgtccgcggcgttcccgtcgactggcaggccttctacgccccggccggagcacagcgcgtgcccctgccgacgtacgccttccagcgctccgtctactggctggacgcgggccgggcacagggtgacatcgcctccgctggactcggcgcgacggaccatccgctgctcagcgccgcggtcgaactgcccgactcggacggtttcctcttcaccggccgcctgtcgctggccacccacccgtggctcgccgaccacgcggtcctgggctccgtactccttccgggtacggctttcgtcgaactcgcgctgcgggccggtgaccaggtcggctgcgacctgatcgacgaactcactctcgaagcaccgctggtgctgcccccgcacggaggcgtccagctgcggctcgccgtcgcggccgccgacgcgacgggtcggcgcaccctggcgttccactcccggagcgaggacgcggacgccgggacgccgtggacccgtcacgcctccggtgtactcgcggtcggggccgagcggactccgcagagcctcaccgagtggccgccgaccggggccgaatccgtaccggtggacgggctgtacgagggcctggccgaatccggcttcggatacggtccggtcttccagggcctgcgtgccgcctggcggcgcgacggcgagtactacgccgaggtcgccctgcccgagggcacggaggacgaggccggacgcttcggcctccacccggccctgctcgacgcggcgctgcacgcgctgggtctgggcagcacggacaccgaaggcggcgaaggacggctgccgttctcctggtccggtgtgcacctgcacgccgtcggtgcctccgcgctgcgcgtacgtctcaccacgtcccgaagcggtgaggtggcgctgaccatcgccgacgcggccggagagccggtcgcgaccgtggccggcctcgcgctgcgggccgtgagccgcgagcagctgagcacggcacgggacctcacgcgtgacgcgctgttccgggtggactggactgcgttgcctgcgggcggtgccgtggggtcgctggacgactggatgttgttgggtgcgggttcgcaggtgtatgcggatctggcggggctgggtgtggctgttgcggagggtggtgggattccggcggcgttggtggtgccggtttcggagcctgatgcggagtctgctgcgggtggtgtggcgggtacggtgcacgcggctgttgagcgtgcgctgtctctggtgcaggagtggttgtcggacgagcggttcgcggatgcgcgtctggtgttcctgacgcggggtgcggtggctgcgcgggccggggacacggttccggggctggtgcaggccgctgtgtggggtctggtgcgctcggcgcagtcggagaatccgggtcgtttcgctctgatcgatgtcgacggcgacggcgacggtgacggtgaagtggacggggacgtgctgtcggccgcgctcgccaccggtgagcctgagctggcggtccgtgaaggggctttgctcgtgccgcgccttgcccgcgccgctgtcgttgagggtgccggtcgtgaactggatgtcgacggcaccgtgttggtcacgggtgcgagcggcaccctgggtggcttgttcgcccgtcatctggtggttgagcgtggtgtgcggcggctgctgttggtcagtcgtcgtggcgaggctgcggaaggtgctgctgaactgggcgccgaactcacggagctgggtgctgatgtgcggtgggcggcgtgtgatgtggccgaccgcgatgcgcttgaggctgtcctggccgggattcctgctgagtatccgttgtcgggtgtggtgcatacggctggtgtgctggacgacggtgtggtgtcgtccctgaccccggagcgcctctcggcggtgctgcgtccgaaggtggatgcggcatggaatctgcatgagctgacccgcggtttggatctgtcgctgttcgtgttgttctcttcggctgccggagtgttcggcggtgcgggtcaggcgaactatgcggcggcgaatgtgttcctggacgctctggcccagcaccgcagggcccagggcctggccgcgacctcccttgcctggggtctgtgggccggtgtgggcggcatgggcggtgagctgacggaatccgaccgcgagcgcatcaaccgcggcggcatcaccgctcttgagcccgagaccggtctcgccctcttcgacgcggcacagcgcaccaccgacgcactgctcgtccccctcccgctcgacctggccgccctgcgcgtccaggccggcagcggaatgcttccggacctgctgcgcggcctggtccgcgtaccggtgcgccgggcggcggggcagggaagcgcggccgggggcgggtcggtactccgtacccgactggctgcgatgcccgccgatgagcgggacgcggccctgctggacctggtccgggccgaggtggcggccgtactcggccacgcgtcgaccgacgaggtaccggccgaccgggcgttcaaggagctcggcttcgactcgctgacctcggtcgagctgcgcaaccgcctcggcgccaccacgggtgaacggctctccgccaccctcgtcttcgactacccgaccccgcacgcgctcgccgagttcctgcgcaccgaggtgctgggcctggacgagccgacggatacggccacgaccgcccccacgcacctcgggacatcgctcgacgacgacccgatcgcgatcgtcggcatgagctgccggtaccccggcggggtcgagacccccgaggacctctggcgcctggtggtgggtggcggcgacgccatctcggagttcccgcagggacgcggctgggaccttgagtcgctctacgacccggacccggacggcaagggcaccagctacacccggtcgggtggcttcctgcacgacgcgggccggttcgacccggcgttcttcgggatctcgccgcgcgaggccgtggcgatggacccgcagcagcggctgctcctcgaaacctcgtgggaggcgttcgagcgggccgggatcgacccggcctcgatgcgcggcagccggaccggtgtcttcgcgggcatcatgtaccacgactacgcgacccggatcacctccgttccggacggggtcgagggctacctcggcaccggaaactccggcagcatcgcctccggccgcgtctcgtacgccttcggcctggagggcccggcggtcaccgtcgacacggcctgctcgtcctcgctcgtcgccctgcactgggcgatccaggcgctgcgcaacggcgagtgcacgatggcgctggccggcggtgtcaccgtcatgtcgacgccgggcaccttcaccgagttcagccgccagcgcggcctggccgccgacggccgcatcaagtccttcgcggccgcggccgacggcaccagctgggccgaaggcgcgggcatgctgctcgtagagcggctgtcggaggcgcgggccaagggccacccggtcctggcgatcgtgcggggctcggcgatcaaccaggacggtgcgagcaacggcctgaccgctccgaacggtccctcgcagcagcgggtgatccgccaggccctcgcgggggcccggctgaccagtgaccagatcgacgtggtggaggcgcacggcacgggcaccaccctcggcgacccgatcgaggcgcaggcgctcctggccacgtacggccgcgagcgcgaggcggaccagccgctgtggctgggctcgatcaagtccaacatgggtcacacgcaggcggccgccggtgtcgcgggcatcatcaagatgatcatggccatccggcacggtgtgctgccgaagaccctgcacgtcgacgagccgactccgcatgtggactgggaggccggtgcggtctcgctcctcaccgagtccgtcccgtggccggagacgggccgtccgcgccgcgccggtgtgtcgtcgttcggtatcagcggcaccaacgcgcacacgatcatcgagcaggcgccggaggagttcgtcccggtccgtgtgaccgagtcgcagacgccgggcgcgggttcgcgagtgctgccgttcgtgttgtccgcgaagtcggcgggggcgttgcgtggtcaggcggtgcgtctgaaggcgcatgtggaggcttcgccggaggtgtctggagccggggccgttgatgtggcgtattcgctggcgacgcggcgtgcggtcttcgaccaccgtgcggtggtggtggccggtgaccgcgaggagttgctgcgttctctggctgctgtggagtcggagggcgcggcggctggtgtgacccgtggggccgtgggtggcggaaagcttgccttcctgttcacgggccaggggagccagcggctcgggatgggccgtgagctgtacgagacgtatcccgtcttcgcgcgggctctggacgcggcgtgtgctcgtcttgaactgccgctgaaggatgcgctgttcggcaccgatgcgggtctgctgggcgagacggcgtacacccagccggctctcttcgcggtcgaggtggcgttgttccgactgctggagagctggggtgtgaggccggacttcctggcgggtcattcgatcggtgagatcgcggccgcccatgtggccggggtgctctccctcgatgacgcctgcgcactggtcgaggcgcgtggtcgtctgatgcaggcgctgccgaccggtggcgtgatgatcgccgtccaggcgtctgaggctgaagtcctgccgctgctgaccgaccgcgtgagtatcgccgcgatcaacggtccgcagtcggtcgtgatcgcgggtgacgaggccgacgcggtggcgatcgtggagtccttctcgggccgcaagtccaagcggctcacggtcagtcacgcgttccactcgccgcacatggacggcatgctggctggcttccgcaaggtggcggagagcctgtcgtacgaggctccgcgcatcccggtcgtctcgaacctcaccggggccctggtcaccgacgagatgggttcggccgacttctgggtgcggcacgtccgcgaggccgtccgcttcctggacggtatccgcaccctggaagccgcaggcgtcgcgacgtacgtcgaactcggccccgatggcgtcctgtcggcgatggcccaggactgcgtcaccggcgagggtgcggccttcgcgcccgccctccgcaagggccgccccgagaccgagacgatcaccacggccctcgcccttgcccacgcccacggcacgtccgtcgactgggagacgtacttcgccgggaccggcgcccagggcgtcgagctgccgacctacgccttccagcgtgactggtactggctgaactcggccgtggtgcaggccggtccgggcgacgcgagcggattcgggctcggcgcgaccgatcaccccctgctcgacgcgaccatcgaactgcccgactcggacggcttcctgttcaccagcaggctgtccctcgacacgcagccgtggctcgcggaccacgccgtcctggggtcggtcctcctcccgggcacggccttcgtggaaatcgccgtacgggcaggtgaccaggtcggttgcgacgtactggaagagctgacgctggaggcaccgctggtggtgcccgagcggggcggtgtgcagctgcggctcaccgtcgccgccgccgacgagtcgggacggcgaggtctgtcgctgtactcccgcgacgaggacgctcccgccgacgagccgtggacgcgccacgccagcggcgtgctcgccaccggcgcggcggcccccgacttcgacctcgccgcctggcccccggccggagccgaaccggtcgacatcgacggcctgtacgagggcctggccgcggccgggttcgactacggtccggccttccagggcctgcgcacggcatggctgcacggcgacgcggtgtacgccgaggtgagcctggacgaggagtccgcggaatcggcggaatggttcgggctgcacccggccctcctggacgcgacgctgcacgcggcgggtctcggcggtctcgtggagagcaccggccagggacggcttccgttcgcctggagcaatgtgtccctgcacgcggccggcgcgtccgcggtacgggtccggctggccccggccggccgtgacgcggtgtctctgcagctcgccgacgcggcgggcgcaccggtcgcctcggtcgaatcgctggtgctgcgggcggtctcgcccgaccagatcggcgcggcgcgcggcggccgtcacgagtcgctcttcgagatcgactgggccgccctcccgctcgccccggtgtccgctgccgaacagcgcccctgggcgctgctggcggacgacgggtccggccacgcgggactcgaagccgtgggtgtccgtcacgaggcccacaccggactcgcggcgctcgccgacaccggacgggcgatccccgaggtcgtgtgcgtcccgctcgctgcggcgaactcccaggacctggcgggtgcgggtgcggtgcacgcggctgtggagcgtgcgctgggtctggtgcaggagtggttgtcggacgagcggttcgcggatgcgcgtctggtgttcctgacgcgcggtgcggtgtccgcggtgccgggcgaggacgtgaccgatctggtccacgctccggtgtggggtctggtgcgttccgcgcagtccgagaacccgggccgcttcgtcctggccgacaccgacggcaccgacgcctcctaccgtgccctgacggccgcgctcgcctcgggcgagccggagttcacggtgcggggcggcgcggtacgggtgcccaggctgacgcgctccactgctgtcgctgtggaggctgtgcccgaactcggttcggacggcacggtgttggtgacgggtgcgagtggcacgttgggtggtttgttcgcccgccatttggtggttgagcgtggtgtgcggcgcctgctgttggtgagtcgtcgtggtggggctgcggagggtgctgctgaactgggcgccgaactcacggagctgggtgctgatgtgcggtgggcggcgtgtgatgtggccgaccgtgatgcgcttgagtccgtcctggccgggattcctgctgagtatccgttgtcgggtgtggtgcatacggctggtgtgctggacgacggtgtggtgtcgtccctgaccccggagcgcctctcggcggtgctgcgtccgaaggtggatgcggcatggaacctgcacgagctgacccgcggtttggatctgtcgttcttcctgttgttctcgtcggctgccggtgtgttcggtggtgccggtcaggcgaactatgcggcggcgaatgtgttcctggacgctctggcccagcaccgcagggcccagggcctggccgcgacctcccttgcgtggggtctgtgggctgagccggggggcatggcgggcgcgctggacgctgatgatgtgtcgcgtctgggccgtggcggtgtcagcgggctctccgcgcaggagggtgtggcgttgttcgacgcggcgtccgcctccgaacaggccctgttcgttcccgtgaagctggacctggccgccctgcgcgcccaggcgggtagcggcatgcttccgccgctgctcagcggtctcgtccgtacccccacccgccgcgccgcgggcaccggcggcaccggagacaccggcacggacggtgggaccgcgctgcgggagcgcctggccgggctcgcaccggccgcgcgggacgaagcgctgctggagctcgtctgcacgtacgtcgcggcggtgctcggcttcgccgggcccgaggcggtcgatccggcgcggtcgttcagcgaggtcggcttcgactcgctgaccgccgtcgagctgcgcaacaggctcggcgccgcgaccggcgtacgcctccccgccaccctcgtcttcgactacccgacaccggacgcgctggtggagtacctgcgcgacgaactctggcaggacggcgccgcggcggtacccccgctgctcgccgaactcgaccggctggagaagacgctcgtggcgtccgtgcccgacgacgacggccgcacccgcatcaccgagcggctgcaggccctgctggccgcctggagcgaggccggcgaatcaacggacaccgccgacgccgatgtggccgaggcgcttgagaccgcgaccgacgatgacctcttcgacttcatcggcaaggagttcgggatctcgtga

SEQ ID NO: 37 - protein, 3872 aa, Streptomyces aizunensis
MNEEKLRYFLKRVTADLHETRRRLQEVESEEQEPIAIVGMSCRYPGDVESPEDLWRLVSEETDAISPFPTDRGWDMGRLFDADPDGRGTSYVQEGGFLHSANRFDPAFFGISPREAVAMDPQQRLLLETSWEAFERAGIDPTSLRGSRTGVFAGVMYHDYASRLRAVPEEVEGYLGTGGSSSIASGRVSYTFGLEGPALTVDTACSSSLVTLHLAMQALRKGECSLALAGGVTVMATPGTFTEFSRQRGLSFDGRCKSFADSADGTGWAEGAGMLLVERLSDARKNGHTVLAVVRGSAVNQDGASNGLTAPNGPSQQRVIRQALADARLTAADVDVVEAHGTGTTLGDPIEAQALLATYGREHTEDSPLWLGSVKSNLGHTQAAAGVAGIIKMVMAIRHGRIPKTLHVDEPSTNVDWSAGAVSLLRESVEWPETGRPRRAAISSFGISGTNAHTIIEQAPLPEAETETEPTGDETDGSESTAGAEGTEGTEGAGVRPVSVPPVLPWPVSARTEEALHAQAERLLAHVRTNPDQAPVGVALSLATGRAALEHRAVVVATDRETALADLAALASGETSARVVLGEPGARGKTAFLFTGQGSQRLGMGRELYEEYPVFADALDAVCARLELPLKDVLFGADARLLDETAYTQPALFAVEVALFRLVESWGLKPDFLAGHSIGEIAAAHVAGVFSLEDACALVSARGRLMGALPAGGVMIAVQASEDEVLPLLTARVSIAAINGPQSVVIAGDEADAVAIVESFTGRKSKRLTVSHAFHSPHMDGMLEDFRVVAEGLSYEAPRIPVVSNLTGALVSDEMGSADFWVRHVREAVRFLDGIRALEAAGVTTYVELGPDGVLSAMAQACVTGENSVFVPVLRSGRSEAESVTTALAQAHVRGIAVDWQAYFAGTGAERVDLPTYAFQRDHYWLDAGTLGGDVTTAGLRSADHPLLGASVALADAEGLLLTGRLSLDTHPWLADHAVAGTVLLPGTAFVELALRAGDQVGCDLIDELTLAAPLVLPEQGGVELQITVAAPDESGRRSVAFHSRADSAADDEAWVRHATAVLAEGADTPVFDFGVWPPTGAESVPVDGLYEGLAHSGFGYGPVFQGLRAAWRQGEDVFAEVSLGDGVEPGAAHFTVHPALLDSALHAINLGTLVEDTGQGRLPFAWSGVAVHAVGADTLRVRLSRAGQDAVALEIADADGAPVASVRSLALRAFSPDQLTGPDGAGHGDALFRVDWAALPAGGAVGSLDDWMLLGAGSQVYADLAGLGVAVAEGGGIPAALVVPVSEPDAESAAGGVAGAVHAAVERALGLVQEWLSDERFADARLVFLTRGAAAARAGDTVPGLVQAAVRGLVRSAQSENPGRFALIDVDGDGEVDAEVLSAALATGEPELAVREAALLVPRLARAAVAVEPAPELGSDGTVLVTGASGTLGGLFARHLVVERGVRRLLLVSRRGEAAEGAAELGAELTGLGADVRWAACDVADREALESVLAGIPAEYPLSGVVHTAGVLDDGVVSSLTAERVSAVLRPKVDAAWNLHELTRGLDLSLFVLFSSAAGVFGGAGQANYAAANVFLDALAQHRRAQGLAATSLAWGLWDEPGGMAGALDADDVSRLGRGGVSGLSAGEGVALFDAASASEQALFVPVKLDLAALRAQAGSGMLPPLLSGLVRTPTRRAARGGSAAGGTFARKLAGLAVDQRSAAVMELVRAQVAAVLGLAGPEAVDPARSFSEVGFDSLTAVELRNRLGAATGVRLPATLVFDYPTSLALADFLGGELLGGQEAAAAPTAFTARDDEPIAIVAMSCRFPGGVRSPEDLWGLVLDGRDAISDMPDDRGWDVEGLFDPDPDRPGTSYSRAGGFLHDAHHFDPTFFGISPREALATDPQQRLLLETSWEAFERAGIDPATVRGSRTGVFAGVMYNDYGTLLHRAPEGLEGYMGTSSSGSVASGRVSYTFGLEGPAVTVDTACSSSLVTLHLAVQALRNGECDLALAGGVTVMATPGTFVAFSRQRGLASDGRCKPFAAAADGTAWGEGVGMLLVERLSDARAKGHPVLAVVRGSAINQDGASNGLTAPNGPSQQRVIRQALASAGLSAADVDVVEAHGTGTTLGDPIEAQALLATYGQEHTDDSPLWLGSIKSNFGHTQAAAGVAGIIKMVQAMHHGVVPKTLHVDEPSPHVDWSAGAVSLLTEQMAWPETGRPRRAAISSFGISGTNAHTIIEQAPEEFAPVRPVRVIEPEAVGAGSRVLPFVLSAKSAGALRGQAVRLKAHVEASPEVSGAGAADVAYSLATRRAVFDHRAVVVAGDREELLRALAAVESEGTAAGVTRGTAGGGKLAFLFTGQGSQRLGMGRELYETYPVFARALDAACAGLELPLKDALFGADAGLLDETAYTQPALFAVEVALFRLLESWGVRPDFLAGHSIGEIAAAHVAGVLSLDDACALVAARGRLMQALPTGGVMIAVQASEDEVLPLLTDRVSIAAINGPQSVVIAGDEADAVAIVESFSGRKSKRLTVSHAFHSPHMDGMLAGFRKVAESLSYEAPRIPVVSNLTGALVTDEMGSADFWVRHVREAVRFLDGIRALEAAGVTAYVELGPDGVLSALAQECVTGEGAAFAPALRKGRPEAETITTALALAHNHGTSVDWETYFSGTGAQRVDLPTYAFQRERYWIDVPVHSVGDVASAGLGAAEHPLLGAAVELPDSDGLLLTGRLSLLSHPWLADHAVAGTVLLPGTAFVELALHAGQRVGSGLLEELTLEAPLVLPERGALQLRVSVAAPDEAGRRALHVHSRPEDLGGEDRTGHEVPWTRHAGGVLAAPEAAGAAPEESGLDVWPPADAEPLDAGDLYDRFAEGGFAYGPVFRNLRAAWRRGDELFAELLLPEGQLAQAGHFGVHPALLDAGLHGLALGSFHDGADEDARIRLPFSFSGVALHSVGAGSLRVRLAPAGSGAVSLAAFDEQGAPVVSVESLLLRAVDPARLKAAEQPVFHESLFRLEWPALAAGPRTDNAPGDGGRWAVVGADSLGLEAGLRADGVAVDGYADLSALAGVVAAGKPQPDTVLVSYASSGPGIRTADAVRQAAHDALELVQGWLAEESLAGSRLVVVTRGAVEARPGEGVPDLAHAAVWGLLRSAQSENPGRFVLLDLDAEDAEVLAPLMAAAVASGEPQLAAREGVLHAARLARVPAAPTAVAGTERAPALDPDGTVLITGGTGSLGSLLARHLVVEHGVRHLLLTSRRGAAAEGAPELVAALAELGAEATVAACDAADREALAALLAGIPAAHPLTAVVHTAGRVDDGLLASLSPERIDTVLRPKADAALHLHELTRGLDLAAFVLFSSAAGTLGNPGQANYAAANAFLDALAQHRRAAGLPAVSLAWGLWEQRSAMTGALSDADVQRMARAGLAPLSSAEGLALFDTACALAPVGATETATGDGAFVAMRLDTAPLRAQADAGALPAVFRGLVRGGPRRAAAHQAADSAASTAARKLAGLSGLPQDEQERVLLDLVRAQVAAVLAYPSPDAVGESQEFLELGLDSLTAVELRNQLNAATGLRLPATLLFDHPTPALVAERLRAELAGASGPAAVREGAADSGAEGSAGVFGAMLHEAGTQGASGQFMELLMQASRFRPSFASAAELRKAPSLVRLSRGDTRPGLVCFSSILSISGPHQYARFASAFRGRRDVHALGAPGFLRGEQLPSATDAVIEAQAEAVLRHADGAPFVLLGHSSGGMLAHAVAGRLESEGVFPQALVMIDIYSHDDDAIIGIQPGLSEGMDERQDTYVPVDDNRLLAMGAYFRLFGGWKPEVVKTPTLLVRAGERFFDWTRSTDGDWRSYWDLDHTALDVPGNHFTMMEEHAPTTAQAVEGWLDTTG

SEQ ID NO: 38 - DNA, 11619 bp, Streptomyces aizunensis
atgaatgaggaaaaactccggtacttcctgaagcgggtgacggccgatctccacgagacgcgccggcgtcttcaggaggtcgagtcggaggagcaggagccgatcgcgatcgtcgggatgagctgccgctacccgggagacgtcgagtcgcccgaggacctgtggcggctggtgtccgaggagaccgacgccatctcccctttccccaccgaccggggctgggacatggggcggctcttcgacgcggaccccgacgggcggggcacgagctatgtgcaggaaggcggcttcctgcactccgccaaccggttcgacccggcgttcttcgggatctcgccgcgcgaggccgtggcgatggacccgcagcagcggctgctcctcgaaacctcgtgggaggcgttcgagcgggccgggatcgacccgacctcgctgcgcggcagccggaccggcgtcttcgcgggcgtcatgtaccacgactacgcctcgcggctgcgtgccgtcccggaggaggtcgagggttacctcggcaccggcggctccagcagcatcgcctccggccgggtctcgtacaccttcggcctggagggcccggcgctcaccgtcgacacggcctgctcgtcctccctcgtcacgctgcacctggccatgcaggcgctccgcaagggcgagtgctcgctcgccctcgcgggcggtgtcaccgtgatggcgacaccgggcaccttcacggagttcagccgccagcgcggtctgtccttcgacggccgctgcaagtccttcgcggactccgcggacggcaccggctgggccgagggcgcgggcatgctcctcgtggagcggctctcggacgcccgtaagaacggccatacggtactcgccgtggtccggggctcggccgtcaaccaggacggtgccagcaacggcctgaccgccccgaacggcccctcccagcagcgggtcatccggcaggccctggccgacgcccgcctcacggcggccgacgtcgacgtcgtggaggcacacggcaccggcaccaccctcggtgacccgatcgaggcgcaggccctgctcgccacgtacggccgggaacacaccgaggacagcccgctgtggctcggctcggtcaagtcgaacctcggtcacacccaggcggccgcgggcgtcgccggcatcatcaagatggtcatggcgatccgccacggccggatccccaagacgctgcatgtcgacgagccgtcgaccaacgtcgactggtcggcgggcgccgtctcgctgctgcgggagtccgtggagtggccggagaccggccgcccgcgccgcgcggcgatctcttccttcggcatcagcggcactaatgcgcacacgatcatcgagcaggctccgctgccggaggccgagaccgaaaccgagccgaccggcgacgagacggacggctctgagagcacggcgggggcagaggggacagaggggacagagggcgccggggtgcggcccgtgtccgtgcctcccgtccttccgtggcccgtctcggcccgtacggaggaggccctgcacgcccaggcggaacgcctgctggcccacgtgcggaccaacccggaccaggccccggtgggcgtcgctctctccctggccacagggcgcgccgcgctggaacaccgcgccgttgtcgtcgccaccgaccgggaaaccgccctcgccgacctcgccgcactggcgtccggcgagacctcggcgcgcgtcgtgctcggcgagccgggagcgcggggcaagaccgcgttcctgttcacggggcaggggagtcagcggctggggatggggcgcgagctgtacgaggagtatcccgtcttcgcggatgcgctggacgcggtgtgtgcccgtcttgaactgcctctgaaggatgtgttgttcggggcggatgcgcgtctgctggacgagaccgcttatacgcaaccggcgctcttcgccgttgaggtggcgttgttccggttggtggagagctggggtctgaagcccgacttcctggccgggcattcgatcggcgagatcgccgccgcgcacgtcgcgggggtgttctcgctggaggatgcttgcgcgctggtgtcggctcgtggccggttgatgggtgccctgcctgcgggtggcgtgatgatcgcggtgcaggcgtcggaggacgaggttctgccgctgctgacggcccgggtgagcattgccgcgatcaatggtccgcagtcggtggtgatcgcgggtgacgaggccgacgcggtcgcgatcgtggagtccttcacggggcgtaagtcgaagcggcttacggtcagtcacgcgttccattcgccgcacatggacgggatgttggaagacttccgggtcgtggcggaggggctgtcgtacgaggctccgcgcatccccgtcgtttcgaacctcaccggggccctggtctcggatgagatgggttcggcggacttctgggtccggcacgtccgtgaggccgttcgcttcctggatggcatccgggccctggaggccgcgggcgtcacgacgtacgtcgaactcggccccgacggtgtcctgtcggcgatggcccaggcatgcgtgaccggcgagaactccgtcttcgtgccggtcctgcgctcgggtcgctccgaggcggagagcgtcaccacggcccttgcccaggcgcatgtccgcgggatcgccgtggactggcaggcctacttcgccggtaccggtgccgagcgcgtcgacctgcccacctacgccttccagcgcgaccactactggctcgacgccggaacgctcggcggagacgtgaccacggcgggccttcgatccgccgatcaccctctgctcggcgcctctgtggctctggcggatgcggagggccttctcctcaccggccggctctcgctcgacacccacccgtggctcgccgaccacgctgtggcggggacggtcctgctgcccggtacggcgttcgtcgaactcgcgctgcgggccggtgaccaggtcggctgcgacctgatcgacgaactcaccctcgcggcgccgctggtgctgcccgagcagggtggagtcgaactccagatcaccgtcgcggcccccgacgaatcgggccgccggtccgtcgccttccactcgcgcgccgacagcgccgcggacgacgaggcgtgggtccggcacgcgaccgcagtactggccgagggcgcggacaccccggtgttcgacttcggcgtctggccgccgaccggggctgaatccgtaccggtggacgggctctacgaggggctcgcgcactccggattcggctacggtcccgtgttccaggggctgcgtgccgcctggcgccagggcgaggacgtgttcgccgaagtgagcctcggggacggggtcgagcccggagcagcgcacttcaccgtgcacccggccctgctcgactccgccctgcacgccatcaacctcggcaccctcgtcgaggacaccggccaggggcgactgccgttcgcatggagcggggtcgcggttcacgccgtgggggcggacaccctgcgcgtacggctctcccgggccggtcaggacgcggtggccctggagatcgcggacgcggacggcgcgcccgtcgcttccgtacgcagcctggccctgcgcgccttctcacccgaccagctgaccgggccggacggcgccggtcacggcgacgcgctgttccgggtggactgggcggcgttgcctgcgggcggtgcggtcgggtcgctggacgactggatgttgttgggtgctggttcgcaggtgtatgcggatctggcggggttgggtgtggctgttgcggagggtggtgggattccggcggcgttggtggtgccggtttcggagcctgatgcggagtctgctgcgggtggtgtggcgggtgcggtgcatgcggctgttgagcgtgcgctgggtctggtgcaggagtggttgtcggatgagcggttcgcggatgcgcgtctggtgttcttgacgcggggtgcggcggctgcgcgggccggggacacggttcccgggctggtgcaggcggccgtgcggggtctggtgcgctcggcgcagtcggagaacccgggccgtttcgctctgatcgatgtcgacggcgatggtgaagtggatgcggaggtgctgtcggccgcgcttgctacgggtgagcccgagctggcagtccgtgaagcggctttgctcgtgccgcgccttgcccgtgccgctgtcgcggtggagcctgcgcccgaactcggttcggatggcacggtgttggtgacgggtgcgagtggcacgttgggtggtttgttcgcccggcatttggtggttgagcgtggtgtgcggcggctgctgttggtcagtcgtcgtggtgaggctgcggaaggtgctgctgaactgggcgccgaactgactgggttgggtgctgatgtgcggtgggcggcgtgtgatgtggccgaccgtgaggcgcttgagtcggtcctggccgggattcctgccgagtatccgttgtcgggtgtggtgcataccgctggtgtgctcgatgacggtgtggtgtcgtcgctgactgccgagcgtgtgtcggcggtactgcgtccgaaggtggacgcggcgtggaacctgcacgagctgacccgtggcctggatctctcgctcttcgtgttgttctcgtcggctgccggtgtgttcggtggtgccggtcaggcgaactatgcggcggcgaatgtgtttctggacgctctggcccagcaccgcagggcccagggtctggccgcgacctctcttgcgtggggtctgtgggatgagccggggggcatggcgggcgcgctggacgctgatgatgtgtcgcgtctgggccgtggtggtgtcagcggactctccgcgggggagggtgtggcgttgttcgacgctgcgtccgcgtccgaacaggccttgttcgttccggtgaagctggacctggccgccctgcgtgcccaggcgggcagtgggatgttgccgccgctgctcagcggtcttgtccgtacccccacccgccgcgccgcccggggcggttcggccgcggggggaacgttcgcccggaagctggccggcctcgcggtggaccagcggtccgcagccgtgatggagctcgtgcgtgctcaggtcgcagccgtgctcggccttgccgggcccgaagcggtagacccggcacggtcgttcagcgaggtcggcttcgactcgctgaccgccgtcgagctgcgcaacaggctcggcgccgcgaccggtgtacgcctccccgccaccctcgtcttcgactacccgacctccctcgccctcgccgacttcctgggtggcgaactgctcggcggtcaggaagcggcagcagccccgacggccttcacggcccgggacgacgagccgatcgcgatcgtggcgatgtcttgccgtttccccggcggcgtgcggtcgcccgaggatctgtgggggctggtcctggacggccgggatgccatctcggacatgccggacgaccgcggctgggacgtcgagggactcttcgaccccgaccccgaccgcccgggcaccagctacagcagggcgggcgggttcctgcacgacgcccaccacttcgacccgacgttcttcgggatctcgccgcgcgaggccctcgccaccgacccccagcagcggctgctcctcgaaacctcgtgggaggcgttcgagcgggccgggatcgatccggccaccgtacgcggcagccggaccggcgtcttcgcgggcgtcatgtacaacgactacggcaccctcctgcaccgcgccccggagggcctcgaaggctatatgggcacctccagctcgggcagcgtcgcctcgggccgggtctcgtacaccttcggtctggagggcccggcggtcaccgtcgacacggcctgctcgtcctcgctcgtcaccctgcacctcgccgtgcaggccctgcgcaacggcgagtgcgacctcgcgctggccggcggtgtcacggtgatggccacgcccggtacgttcgtcgcgttcagccgtcagcgcggcctcgcgagtgacggccgctgcaagccgttcgccgcggccgccgacggtacggcgtggggcgagggcgtcggcatgctgctcgtcgagcgcctgtcggacgctcgggccaagggccacccggtgctcgcggtggtccgtggctcggcgatcaaccaggacggtgccagcaatggcctgacggctccgaacggtccctcgcagcagcgggtgatccgccaggcgctggccagtgccggtctgtcggcggcggatgtggacgtagtggaggcgcacggcaccggcaccaccctgggcgacccgatcgaggcgcaggcactcctcgccacctacggtcaggagcacacggacgacagcccgctgtggctggggtccatcaagtccaacttcggtcacacgcaggccgctgccggtgtcgcgggcatcatcaagatggtgcaggcgatgcaccacggggtcgtccccaagacgctgcacgtggacgagccgtccccgcacgtggactggtcggcgggcgcggtctcgctcctcaccgagcagatggcctggcccgaaaccggccgtccccgccgcgcggcgatttcttccttcggtatcagcggtaccaacgcgcacacgatcatcgagcaggcgccggaggagttcgctccggtccgtccggtccgtgtgatcgagccggaggcggtgggtgcgggttcgcgggtgctgccgttcgtgttgtccgcgaagtcggcgggggcgttgcgtggtcaggcggtgcgtctgaaggcgcatgtggaggcttcgccggaggtgtcgggggccggggctgctgatgtggcgtattcgctggcgacgcggcgtgcggtcttcgaccaccgtgcggtggtggtggccggtgaccgtgaggagctgttgcgtgctctggctgctgtggagtcggagggcacggcggctggtgtgacccgtgggacggcgggtggcggaaagcttgccttcctgttcacgggccaggggagccagcggctggggatggggcgtgagctgtacgagacctatcccgtcttcgcgcgggctctggacgcggcgtgtgctggtctcgaactgccgctgaaggatgcgctgttcggcgccgatgcgggtctgctggacgagacggcgtacacccagcccgctctcttcgcggtcgaggtggcgttgttccgactgctggagagctggggtgtgaggccggacttcctggccgggcactcgatcggtgagatcgcggccgcgcatgtggccggggtgctgtccctggacgacgcctgtgcgctggtcgcggcccgcggccggctcatgcaggcgctgcccaccggcggtgtgatgatcgccgtccaggcgtcggaggacgaggtcctgccgctgctgaccgaccgggtgagcatcgccgcgatcaacggtccgcagtcggtcgtgatcgcgggcgacgaggccgacgcggtggcgatcgtggagtccttctcgggccgcaagtccaagcggctcacggtcagtcatgcgttccactcgccgcacatggacggcatgctggctggcttccgcaaggtggcggagagcctgtcgtacgaggctccgcgcatcccggtcgtctcgaacctcaccggggccctggtcaccgacgagatgggttcggccgacttctgggtccggcacgttcgcgaggcggtccgtttcctggacggtatccgggccctggaggccgcgggcgtgacggcgtacgtcgaactcggtcccgacggtgttctgtcggcgttggcccaggagtgcgtcaccggcgagggtgcggccttcgcgcccgccctccgcaagggccgccccgaggccgagacgatcacaacggccctcgcccttgcccacaaccacggcacgtccgtcgactgggagacgtacttctccgggaccggcgcccagcgcgtcgacctgcccacctacgccttccagcgcgagcgctactggatcgacgtgcccgtccactccgtcggcgacgtggcctccgccggactcggtgcggcggagcacccgctgctgggcgcggccgtcgaactgcccgactccgacgggctgctgctcaccggtcggctgtcgctcctgtcgcacccctggctggccgatcacgccgtcgcgggcaccgttctgctccccgggaccgccttcgtggagctggcgctccacgccgggcagcgggtgggcagtggcctgctcgaagagctgaccctggaggcgccgctggtgcttcccgagcgcggggcgctccagctgcgggtgtccgtggccgcgcccgacgaggcggggcgtcgtgcgctgcacgtgcactcgcgtcccgaggacctgggcggcgaggaccgtacggggcacgaggtgccgtggacgcggcacgccggcggtgtgctcgccgcgccggaggcggccggtgccgcgccggaggagtccggcctggacgtctggccgcccgcggacgccgaaccgctcgatgccggcgacctgtacgaccggttcgccgagggcgggttcgcgtacggtcctgtcttccgcaacctgcgcgctgcctggcggcgcggcgacgagctgttcgccgaactgctcctgcccgaggggcagctcgcccaggccggccacttcggtgtgcacccggcgctgctggacgcgggtctgcacggcctcgcgctcggctcgttccatgacggtgcggacgaggacgcccggatccggctcccgttctccttcagcggtgtcgctctgcactcggtcggcgcgggctcgttgcgcgtacggctcgccccggccgggtccggcgcggtgtcgctcgcggccttcgacgagcagggcgcaccggtcgtgtcggtggaatcactgctgctgcgggcggtggatccggcacggctgaaggccgcggaacagccggtgttccacgagtcgctcttccggctggagtggccggcgctggccgcgggcccgcgtacggacaacgcccccggggacggcggccggtgggccgtggtcggggccgactcgctcggccttgaggccgggctgcgggcggacggcgtcgccgtcgacgggtacgcggacctgtccgcgctcgccggagtcgtggccgcgggcaagccgcagccggacacggtgctggtctcgtacgcctcctcgggtcccggcatcaggacggcggacgccgttcggcaggcggctcacgacgcgctggagctggtccagggctggctcgccgaggagtcgctcgccgggtcacgactggtcgtggtcacccgcggcgcggtcgaggcgcggcccggcgagggcgtgcccgatctggcgcacgcggcggtgtggggcctgctgcggtccgcgcagtccgagaaccccgggcggttcgtactgctcgacctcgacgcggaagacgcggaggtcctggctccgctgatggccgccgctgtggcgagcggggaaccccagctcgccgcccgcgagggcgtcctgcatgccgcgaggctggcacgggttcccgccgcccccaccgcggtggcgggcacggagcgcgcgcccgccctcgaccccgacggtacggtcctcatcaccggcggcaccggatcgctcggcagcctgctggcccgccacctggtcgtggagcacggcgtacggcacctgctgctgaccagccggcgcggtgccgccgccgagggcgccccggaactcgtcgccgcactggccgaactgggcgccgaggcgaccgtcgccgcgtgtgacgccgccgaccgggaggcgctggccgcgctgctggccggcattccggccgcgcaccccctcacggccgtcgtccacacggcgggccgcgtcgacgacgggctcctggcgtcgctcagcccggagcggatcgacacggtgctgcgtcccaaggccgacgcggcgctgcatctgcacgagctgacccgcgggctggacctcgccgcgttcgtcctgttctcctccgcggccggaaccctcggcaaccccggccaggccaactacgcggcggccaacgccttcctggacgccctggcacagcaccggcgcgcggcggggctgcccgcggtgtcgctggcctgggggctgtgggagcagcgcagcgcgatgaccggagcgctgtcggacgcggacgtccagcggatggcacgcgccggactcgcgcccctctcctcggcggagggcctggccctcttcgacacggcgtgcgccctcgcgccggtgggcgccacggagaccgccaccggcgacggagcgttcgtcgccatgcggctggacaccgcgcccctgcgggcccaggcggacgccggagcccttccggcggtcttccgcgggctggtgcgcggaggtcctcgcagggccgccgcacatcaggccgccgattcggcggcatccactgccgcgcgaaagctcgcgggcctgtccgggctgccgcaggacgagcaggagcgcgtgctgctcgacctggtgcgcgcccaggtggccgccgtactcgcctatccgtcgccggacgcggtgggggagtcgcaggagttcctggagctgggtctggactcgctgaccgccgtcgagctgcgcaaccagctgaacgcggcgaccggcctgcggctgcccgccaccctgctcttcgaccaccccactcccgcgctggtcgccgagcggctgcgcgccgaactcgccggagcctccggcccggcggcggtccgggagggcgcggcggacagcggcgcggagggctccgcgggtgtcttcggggccatgctccacgaggccggaacgcagggtgcgtccgggcagttcatggagctgctcatgcaggcgtcgcggttccggccgtcgttcgcctcggcggccgagctgcgcaaggcgccgagcctcgtgcggctctcccgcggtgacacccggccgggactggtctgtttctcctcgatcctgtcgatctcgggcccgcaccagtacgcgcgcttcgcctccgcgttccggggccgccgggacgtgcacgcgctcggtgcccccggcttcctgcggggcgagcagctgccctcggccaccgacgcggtgatcgaggcccaggcggaggccgtgctccggcacgcggacggtgcgccgttcgtcctcctcggccactcctcgggcggcatgctcgcccacgcggtggccgggaggctggagagcgagggggtcttcccccaggcgctggtgatgatcgacatctactcgcacgacgacgacgcgatcatcggcatccagcccggcctctccgaggggatggacgagcggcaggacacctacgtaccggtcgacgacaaccggctgctggcgatgggcgcgtacttccggctgttcggaggctggaagcccgaggtggtgaagacgccgaccctgctggtccgggcgggtgagcggttcttcgactggacccggtccacggacggcgactggcgttcgtactgggacctggaccacacggccctggacgtgccgggcaaccacttcaccatgatggaggagcacgctccgacgaccgcacaggccgtcgaggggtggctggacacgaccggctga

SEQ ID NO: 39 - protein, 338 aa, Streptomyces aizunensis
MTTSDSRSDSRSGSDSGFNSGFDSEQTPSTETAIVFPGMGPSSFAEVGKFLLLDPYARRRLAEADEALGYSVFDRFRTSEDDYSVYSQIAFLVNSMAMADRAVDALGISPTVCAGPSFGQKAASAFVGSLPFADVVRLTAELARCEEEYFADAYQDVVTHCFVRTPQDRLDEILAGFDDRGAWYDISGRLDAAFHMVSVQEKELDGLKAGISAVGGYSMYSMRPPVHAAAFSALRRKAEEEVFAAYELADPTLPVVNDQDGGVVRDAAGMRTMMLDTFDRPVHWPGVVESLKGLGVGTVCVTGPDNLFHRLDLTKDSFEVVTVGLPKKRSREREKRVA

SEQ ID NO: 40 - DNA, 1017 bp, Streptomyces aizunensis
atgaccacttctgattcccgttccgactcccgttccggctccgactccggcttcaactccggcttcgactccgagcagactccctcgaccgagacggcgatcgtctttcccggtatgggcccctcgtccttcgcggaggtcggaaagttcctgctgctcgacccttacgcgcgccggcgcctcgcggaggcagacgaggcgctcggatattcggtgttcgaccgtttccgcacctccgaggacgactactcggtctattcgcagatcgccttcctggtgaattcgatggctatggccgaccgggcggtggacgcgctcggcatctctcccaccgtctgcgccggcccgagtttcggccagaaggccgcctccgctttcgtcgggtcgctgcccttcgcggacgtcgtccggctcaccgcggagctggcccgctgcgaggaggagtacttcgccgacgcgtaccaggacgtcgtcacgcactgcttcgtccgcaccccgcaggaccggctggacgagatcctggccggcttcgacgaccgcggtgcctggtacgacatctccgggcggctggacgccgctttccacatggtgtccgtacaggagaaggagctggacgggctgaaggcgggcatcagcgcggtcggcggctactccatgtactcgatgcgcccgcccgtgcacgcggcggccttctcggcgctgcgccgcaaggcggaggaagaggtcttcgccgcgtacgaactggccgaccccaccctgcccgtggtcaacgaccaggacggcggggtcgtccgggacgccgccgggatgcgcacgatgatgctggacaccttcgaccggcccgtccactggccgggcgtggtggagtccctcaaggggctcggcgtgggcacggtgtgcgtgaccgggcccgacaacctcttccaccgcctcgacctcaccaaggacagcttcgaggtcgtgacggtggggctgccgaagaagcgctcccgcgagcgtgagaagcgcgtcgcctga

SEQ ID NO: 41 - protein, 283 aa, Streptomyces aizunensis
MTATLTAPDPVTDFPAELRPARTDVRTATRTFFFILWRDIFVTGRELGPFLAQVLVEPFFILFVFGKVLGELGYTGGGFQQILLPGVVALNSFLVSLQNTALPLVIDFSWTKEIEDRLLAPIPTSLVAVEKLVFGALRGIIASLVMIPVGFLILDDVSWPMDSFLPTLGVLLTGALAGSTVGLTIGTLAPPRHISVIFAVTLTPLMFTGCTQFPWHSLADIRWFQVLCAINPLTYVSEGIRALLLPPGGPGSIPLWIDLLALSGAIVVFGLIGIKGFHRRAQD

SEQ ID NO: 42 - DNA, 852 bp, Streptomyces aizunensis
atgacggccaccctgaccgcacccgacccggtcaccgacttcccggccgaactgcggcccgcgcgcaccgacgtgcgcaccgcgacccgcacgttcttcttcatcctgtggcgggacatcttcgtcaccggccgcgaactgggcccgttcctcgcccaggtgctcgtggaaccgttcttcatcctgttcgtcttcggcaaggtcctcggcgaactcggttacaccggcggcgggttccagcagatcctgctcccgggcgtggtcgcgctcaacagcttcctggtcagcctgcagaacaccgcgctgcccctggtcatcgacttctcctggaccaaggagatcgaggaccggctcctcgcgcccatccccaccagcctggtggccgtcgagaagctggtcttcggggcgctgcgcggcatcatcgcctcactggtgatgatccccgtcggcttcctgatcctcgacgacgtgtcctggccgatggacagcttcctgcccacgctgggcgtgctgctgacgggcgcgctggcgggcagcacggtgggtctgaccatcggcacgctggccccgccgcggcacatcagcgtcatcttcgccgtgacgctgaccccgctgatgttcaccggctgcacccagttcccctggcacagcctggcggacatccgctggttccaggtgctgtgcgccatcaacccgctgacctacgtcagcgaggggatccgcgccctgctgctgccgccgggcggccccggctcgattccgctgtggatcgatctgctcgccctgagcggggcgatcgtggtcttcgggctgatcggcatcaaggggttccaccgcagggcgcaggactga

SEQ ID NO: 43 - protein, 329 aa, Streptomyces aizunensis
VDSAVVVDGLVKKYRSRDRPAVDDLSFSVRRGEVFGFLGPNGAGKTTTIGILTTRVAPTAGRAFVQGVDVVAHPAQARRAFAVVPQRNNLDRSLTLRQNLTFHAGYHGMSRSERGRLADECLEWVGLADRGKARGDELSGGQAQRVMIARALMHRPDVLFLDEPATGLDPQARLFIHERVAELSKRGVTTVLTTHDMDEAAKLCDRVGIVDHGRLLALDTPQALTRSLSSTALTLTVQPAGHDAESVVRLLERIETVERVELAHQEHAKEQGGAPAPVRLRLYSDAPSGAVLPTAITALTEASHDIKDVSVGTATLEDVFIKLTGRELR

SEQ ID NO: 44 - DNA, 990 bp, Streptomyces aizunensis
gtggattccgccgtcgtggtcgacggactagtcaagaagtaccggagccgcgaccgaccagcggtggacgacctgagcttctcggtccgcaggggcgaggtcttcggattcctcggcccgaacggggcgggcaagacgacgaccatcggcatcctcaccacccgcgtggcccccacggcggggcgagcgttcgtccagggcgtcgacgtcgtggcccaccccgcccaggcgcgccgggccttcgccgtcgtaccgcagcgcaacaacctcgaccggtcgctgaccctccggcagaacctgaccttccacgccggctatcacggcatgagccgctccgaacgcggacggctcgccgacgagtgcctggagtgggtgggtctcgccgaccggggcaaggcccgcggcgacgaactctccggcggccaggcccagcgcgtgatgatcgcccgggccctgatgcaccgccccgacgtgctcttcctcgacgagcccgccaccggactcgatccgcaggcacggctgttcatccacgagcgcgtggccgagctgagcaagcgcggggtgaccaccgtgctgaccacgcacgacatggacgaagccgccaagctctgcgaccgcgtcggcatcgtcgaccacggccgactgctggccctcgacaccccgcaggcgctgacccggagcctgagcagcaccgccctcaccctcaccgtccagcccgcggggcacgacgccgagagcgtcgtacgcctgctggagcggatcgagacggtcgagcgggtcgagctggcacaccaggaacacgccaaggagcagggcggcgcgcccgcgccggtacggctccgcctctacagcgacgcgccgtccggcgcggtgctgccgaccgccatcacggccctgacggaagcgagtcacgacatcaaggacgtgagcgtcggaaccgcgaccctggaggacgtcttcatcaagctcaccggccgggagctgcgatga

SEQ ID NO: 45 - protein, 317 aa, Streptomyces aizunensis
VSAGFGVEPGSLRWMVIGATGMLGGEVAAQLTARGADPVGVGSADLDLTDPQAVAAAVADGGPDVVVNCAAWTAVDLAETEEEAALAVNGTGAGHLARACAATGSRLLHVSTDYVFRGAPADAGHPYAEDAEPDPATAYGRTKLVGERAVLAELPATAAVVRTSWLYGRDNGGFVHTMARLAREPGRTVDVVDDQHGQPSWTPDVAARIIELAALPADRAHGVFHATGGGRTTWYDLAREVFRLTGQDPDRVRRIDSSGLRRAAVRPAWSVLGHDRWAATGLAPMRHWRTALADALMGDPVGDRLPESVNSPGPKGC

SEQ ID NO: 46 - DNA, 954 bp, Streptomyces aizunensis
gtgtccgcgggctttggggtggaacccgggtcgctgcggtggatggtgatcggcgcgacgggcatgctcggcggcgaagtggccgcccagctcacggcccggggcgccgacccggtgggggtcggcagtgcggatctggacctcaccgacccgcaggcggtcgccgcggccgtggccgacggcggccccgatgtcgtcgtcaactgcgccgcctggaccgccgtggacctggccgagaccgaggaggaggcggccctcgccgtcaacgggacgggagcgggccacctcgcccgggcctgcgccgccaccggcagccggctcctccacgtctccaccgactacgtcttccgaggtgccccggccgatgccggacacccctatgcggaggacgccgaacccgaccccgccaccgcgtacggacgcaccaagctcgtcggcgagcgcgccgtcctcgccgaactccccgccaccgctgccgtggtgcgcacgtcctggctgtacggacgcgacaacggcggcttcgtgcacaccatggcccggctcgcgcgcgagccgggacgcaccgtggacgtggtcgacgaccagcacggacagccgagctggacccccgatgtcgcggcccggatcatcgagctcgccgccctgcccgccgaccgggcgcacggcgtcttccatgccaccggcgggggccgcaccacctggtacgacctggcccgcgaggtgttccggctgaccggccaggacccggaccgggtccggcgcatcgacagctccgggctgcgacgggcggcggtccgcccggcatggagcgttctgggccatgaccgctgggccgccacggggctcgccccgatgcgtcactggcgcacggccctcgcggacgccctcatgggcgaccccgtgggcgaccgacttcccgagagtgtgaactcccccggcccgaaaggctgttga

SEQ ID NO: 47 - protein, 204 aa, Streptomyces aizunensis
VKSLSIEGAWLYEPLLHDDERGTFLEVFQSQAFELATGRRLELAQVNCSVSRRGVVRGVHFADLPPGQAKYVTCVRGAVRDVIVDLRTGSPTYRAWEAVELDDRDRRAVFLSEGLGHAFQAITDDATVVYLTTSGYAPGREHGVHPLDPELGITWLPGMEPLLSPKDAVAPTLAVAEAQGLLPAYEDCVRYVSSLATPLSEETP

SEQ ID NO: 48 - DNA, 615 bp, Streptomyces aizunensis
gtgaaatccctgtcgatagagggcgcctggctctatgagccgctgctccacgacgatgagcgcggcacgttcctggaggtgttccagagccaggccttcgagctggccaccggccgccgcctcgaactggcccaggtcaactgctccgtgtcccgccgcggcgtcgtgcgcggcgtccacttcgccgacttaccgcccggccaggccaagtacgtcacctgcgtacgcggcgcggtgcgcgatgtgatcgtggacctgcgcaccggctcgcccacctaccgcgcctgggaggccgtcgaactcgacgaccgcgaccggcgggcggtcttcctctccgagggcctcggccacgccttccaggcgatcaccgacgacgccaccgtcgtctacctgaccacctcgggctacgcccccggccgtgagcacggcgtccacccgctcgacccggagctgggcatcacctggcttcccggcatggaaccgctgctgtccccgaaggacgctgtcgcccccaccctcgcggtggccgaggcccagggtctgctgcccgcgtacgaggactgcgtacggtacgtgtcctcgctcgccacaccactcagcgaggagaccccgtga

SEQ ID NO: 49 - protein, 328 aa, Streptomyces aizunensis
VANKPILFYVLEGIADAGVTDVGIIVGDTADEIRAAVGDGSRFGISVTYIPQHQPLGLAHAVRIARDWLGEDDFVMYLGDNFLLGGISEQLEEFRTRRPAAQIMLTRVPDPSAFGVVTLDEAGRVTGLEEKPKFPKSDLALVGVYFFTAAVHDAVDAIQPSARGELEITEALQWLLDKGLGIASSTVNGYWKDTGNATDMLEVNRTVLDRLTPYCDGSVDGESELVGRVVVEDGAVITRSRIVGPAIIGRGTRVEGSYIGPFTSVGADCVVVDSEIEYSIVLAGAAIDGVGRIEASMIGRQAQVTPAPRTPQAHRLILGDHSKVQIRS

SEQ ID NO: 50 - DNA, 987 bp, Streptomyces aizunensis
gtggccaacaaacccatcctcttctacgtcctggaagggatcgccgacgcgggcgtcaccgatgtcggcatcatcgtcggcgacacggccgacgagatcagggcggccgtcggcgacggctcccgcttcggcatcagcgtcacctacatcccgcagcaccagccgctcggcctggcccacgccgtgcgcatcgcacgggactggctcggcgaggacgacttcgtgatgtacctgggcgacaacttcctgctcggcgggatcagcgagcagctggaggagttccgcacccggcggcccgccgcgcagatcatgctcacccgggtccccgatccctccgccttcggcgtcgtcaccctcgacgaggcgggccgggtcaccggcctggaggagaagccgaagttccccaagagcgatctcgcgctggtcggcgtgtacttcttcaccgccgccgtgcacgacgccgtggacgccatccagccctccgcccgcggcgagctggagatcaccgaggccctccagtggctcctcgacaagggcctcggcatcgcgtcctccacggtcaacggctactggaaggacaccggcaacgccaccgacatgctggaggtcaaccgcacggtgctcgacaggctgaccccgtactgcgacggctccgtcgacggcgagagcgaactggtcggccgggtcgtcgtcgaggacggcgcggtgatcacccgctcccggatcgtgggccccgccatcatcggccgcggcacccgcgtcgagggctcctacatcggcccgttcacctccgtcggggcggactgcgtggtcgtcgacagcgagatcgagtactccatcgtgctggccggcgcggccatcgacggcgtcggccggatcgaggcgtccatgatcggccgtcaggcgcaggtcacccccgcgccccgcacgccccaggcccaccgtctgatcctcggcgaccacagcaaggtgcagatccgttcatga

SEQ ID NO: 51 - protein, 328 aa, Streptomyces aizunensis
MNILITGAAGFIGSHLVRTILGPDKPLGDDVRVTVLDALTYAGNRASLAAVEDEPGFTFVHGDITDALLVDRLVAAHDAVVHLAAESHVDRSIWRADAFVRTNVLGTHTLLEAALRHGTGPFVHVSTDEVYGSVPVGSSVESDPLTPSSPYSASKASSDLLALAYHHTHGLDVRVTRCSNNYGPYQHPEKVIPLFVTRLLSGAAVPLYGDGGNVRDWLHVDDHCRALLAVLTDGRAGHTYNIGGGTELTNKELTGLLLDACGAGWDRVEHVTDRKGHDRRYSVDWTKIRTELGYTPAHDFAEGLAETVAWYRTNRPFWAAPGAELQGA

SEQ ID NO: 52 - DNA, 987 bp, Streptomyces aizunensis
atgaacatcctgatcacgggagcggccggcttcatcggctcccacctcgtacgcacgatcctgggcccggacaaaccgctcggcgacgacgtccgcgtcaccgtcctggacgcgctgacctacgcgggcaaccgcgcctccctcgccgccgtcgaggacgaaccgggcttcaccttcgtgcacggcgacatcaccgacgcgctgctggtggaccgcctggtggcggcccacgacgccgtggtgcacctggccgccgagtcgcacgtcgaccgttcgatctggcgggccgacgcgttcgtacgcaccaatgtgctcggcacccacaccctgctggaggccgcgctgcggcacggcaccggcccgttcgtgcacgtgtcgaccgacgaggtgtacggctcggtcccggtcggctcgtccgtcgagagcgacccgctgacgcccagctcgccctactccgcgtccaaggcgtccagtgatctgctggccctggcctaccaccacacccacggactcgacgtgcgggtgacgcgctgctccaacaactacgggccctaccagcacccggagaaggtgatcccgctcttcgtcacccggctgctcagtggcgccgccgtcccgctctacggcgacggcgggaacgtacgcgactggctgcacgtcgacgaccactgccgcgctctgctggccgtcctcaccgacgggcgcgcggggcacacgtacaacatcggcggcggcaccgagctcaccaacaaggagctgaccggcctgctgctggacgcctgcggcgccggatgggaccgggtcgagcacgtcaccgaccgcaagggccacgaccgccggtactccgtcgactggacgaagatccgcaccgagctgggctacacccccgcgcacgacttcgccgagggcctcgccgagaccgtcgcctggtacagaaccaaccgcccgttctgggcagcgcccggggcggagcttcagggcgcatga

SEQ ID NO: 53 - protein, 214 aa, Streptomyces aizunensis
MTHEGTRHSTRETTPDDVSLIQIRQPAIPSSYRMICFPSSRNSSICYLAMSELLLPTVELLIVQYPALTSEEEHSAEEDAALADKIFEAVRGWADRPLALFGHRLGAELAYAVAQRLERETDAAPLTLFVSGRTGPGHRGSLGPPALNCRVVALAGYHDPRAPLAGVRAWRRCTAGRFDLEVFPGTRGYLDSHRREVVNLVHDQLISLRGPEPD

SEQ ID NO: 54 - DNA, 645 bp, Streptomyces aizunensis
atgacgcatgagggcacccggcactccacgagggagaccacccccgacgacgtcagcctgatccagatccggcagccggcgatcccgagcagctaccgcatgatctgtttccccagttcgcggaactcctcgatctgctatctggccatgtcggaactgctgctgcccaccgtggaactgctcatcgtccagtacccggccctgacctccgaggaggagcattcggccgaggaggacgcggcgctcgccgacaagatcttcgaagcggtccggggctgggccgaccgcccgctcgccctcttcgggcaccgcctcggtgccgaactcgcctacgcggtcgcccagcggctggaacgggagaccgacgcggcacccctgaccctgttcgtctccggacgcacgggaccgggccaccgcggcagcctcggcccgcccgcgctcaactgccgggtcgtcgccctggccgggtaccacgacccccgcgcacccctggccggggtacgggcctggcggcgctgcacggcgggacggttcgacctggaggtctttcccggcacccgcggctacctcgactcgcaccgccgcgaggtcgtcaacctcgtgcacgaccagctgatttcgctccgcggaccggagcccgactga

SEQ ID NO: 55 - protein, 470 aa, Streptomyces aizunensis
VRPMTAKIFAVDSVRPIDEFEQDALRVADVIRERGVCLGDRVMLKAGNSASYVCVLYALMHIGASIVLVDQQEHKEETRRIALRTGVKVTFVDDETPIDQDADPIHLYELMVATQNRPPMDSALSFDAWGELSDGLIMWTSGSTGSPKGVVKSGGKFLANLRRNAHQVGHRPDDVLMPLLPFAHQYGLSMVLIAWLTRCSLVIAPYRRLDRALRMARDSGTTVIDATPSSYRSILGLVTRKPALRAHLAGTRMFCVGAAPLDAPLVESYVQEFGLPLLDSYGSTELNNIAFATLDNPVSCGRAMEGIGLRIVDEDGREVAAGQPGEIEVDTPDALEGQIAEDGSIIPAPTGWQRTGDLGHLDADGNLYVLGRKFAVHRMGYTLYPELIERKVAAEGCPTRIVPLPDELRGSQLVFFVEDDEQRDAGYWRERLCGLLPAFEQPNKVVVLEQFPLNRNGKPDKKELTRMAAE

SEQ ID NO: 56 - DNA, 1413 bp, Streptomyces aizunensis
gtgcgaccgatgaccgcgaagatctttgcagtcgactcggtacgacccatagacgagttcgagcaggacgccctccgcgtcgccgatgtgatccgcgaacgcggagtctgtctcggcgaccgggtcatgctgaaggccggcaactcggcgagctacgtctgtgtgctgtacgcgctgatgcacatcggcgcctcgatcgtcctcgtcgaccagcaggaacacaaggaggagacccgccgcatcgcgctgcgcaccggcgtcaaggtcaccttcgtcgacgacgagaccccgatcgaccaggacgccgaccccatccacctgtacgaactcatggtggccacccagaaccgtccgcccatggacagcgccctgtcgttcgacgcctggggcgagctgtccgacggcctcatcatgtggacctcgggctccaccggatcgcccaagggcgtggtgaagtccggcgggaagttcctggccaacctccggcgcaacgcccaccaggtcggccaccgtcccgacgacgtcctgatgccgctgctgccgttcgcccaccagtacggcctgtcgatggtcctcatcgcctggctcacccgctgctccctggtgatcgccccctaccggcgtctggaccgggcgctgcgcatggcccgcgactcgggcaccacggtcatcgacgcgaccccctccagctaccggagcatcctgggcctggtgaccaggaagcccgccctgcgcgcgcacctggcgggcacccggatgttctgtgtcggcgcggccccgctcgacgcaccgctggtggagagctacgtacaggagttcggcctgccgctgctcgacagctacggctcgaccgagctgaacaacatcgccttcgccaccctcgacaacccggtctcctgcggccgtgccatggagggcatcgggctccggatcgtcgacgaggacggccgggaggtggcggccgggcagccgggcgagatcgaggtcgacacccccgacgcactcgaagggcagatagccgaggacggttcgatcattccggcgcccaccggctggcagcgcacgggcgacctcggccacctcgacgcggacggcaacctctacgtcctgggacgcaagttcgccgtgcaccgcatgggctacacgctctatcccgagctcatcgagcgcaaggtcgccgccgagggctgccccacccggatcgtgcccctgcccgacgaactgcgcggctcccagctggtgttcttcgtcgaggacgacgagcagcgggacgccggctactggcgggagcggctgtgcggcctgctgcccgccttcgagcagcccaacaaggtggtcgtcctggagcagttcccgctcaaccgcaacggcaagccggacaagaaggagctgacgcggatggccgccgaatag

SEQ ID NO: 57 - protein, 553 aa, Streptomyces aizunensis
MTSFSPAPTTMLVPDFPFSYDGWLRHPAGLGALPPERAGTPVAVVGGGMAGMTAAYELMRLGLRPVVYEAEQLGGRMRSVPFPGQPGLVAEMGAMRFPLSARSLFHYIDLLGLRTSPFPNPLAANTPSTLIDLGGERHTARSAEQLPDVYQEVASAWEKALQERAELATMRDAIQRRDVETVKQIWNRLVREFDDQSFYGFLATSSAFPSFRHREIFGQVGFGTGGWDTDFPNSLLEILRVVYTEADDNQVAIDGGSQQVPRGLWEHRPRGCAHWPAGTSLASLHGGTARPRVRAVARDGDGFLVTDADGHRERFASVVYTPHVWTLLNRVACDPALLTQPLWTAVERTHYMGASKLFVLADRPFWNDTDPRTGRPVMSMTLTDRMPRGVYLFDDGPDRPGVMCLSYTWNDDSLKMATLSADERLDVLLEKLGVIYPGVDIRSHVIGDPITITWESEPHFMGAFKSNLPGQYRYQRRLFTQFMQRGLPRAQRGFFLCGDDVSWTAGFAEGAVTTALNAVWGVLDHLGGATPPGNPGPGDLFDALAPLDLPYDS

SEQ ID NO: 58 - DNA, 1662 bp, Streptomyces aizunensis
atgacgtcattcagcccggctcccaccaccatgctcgtgcccgacttcccgttctcctacgacggctggctgcgccatcccgccggactcggcgcccttccgcccgagcgcgccggtacgccggtggccgtggtcggcgggggaatggcgggaatgaccgccgcgtacgaactgatgcggctgggcctgcgcccggtcgtatacgaggcggagcaactgggtggccggatgcggtcggtgcccttccccgggcagcccggcctcgtggcggagatgggggcgatgcgcttcccgctctccgcgcgctcgctgttccactacatcgacctgctggggctgcgcaccagccccttccccaacccgctggcggcgaacaccccgagcaccctcatcgacctcggcggcgaacggcacaccgcgcggtccgcggagcaactcccggatgtgtaccaggaggtggcctcggcctgggagaaggccctgcaggagcgggccgagctggccaccatgcgggacgccatccagcgccgcgacgtcgagacggtgaagcagatatggaaccgactggtcagggagttcgacgaccagtccttctacgggttcctggcgaccagttcggcgttcccgtcgttccggcaccgggagatcttcggccaggtggggttcggcaccggcggctgggacaccgacttccccaactcgctcctcgaaatcctgcgcgtggtctacaccgaggcggacgacaaccaggtcgccatcgacggcggctcccagcaggtgccgcgcgggctgtgggagcaccggccgcggggctgcgcgcactggccggccggcacctctctcgcctcgctgcacggagggacggcccggccacgggtgcgggccgtcgccagggacggtgacggcttcctcgtcaccgacgccgacggacaccgggagcggttcgcctcggtggtgtacaccccgcacgtgtggaccctgctgaaccgggtcgcgtgcgatccggcgctgctgacgcagccgctgtggaccgccgtggagcgcacccactacatgggggcctccaaactgttcgtcctggccgaccggcccttctggaacgacaccgatccgcggaccggccgtccggtgatgagcatgacgctcacggaccggatgccgcgcggggtgtatctcttcgacgacggcccggaccgccccggcgtgatgtgcctgtcgtacacctggaacgacgactcgctgaagatggcgacgctgagcgccgacgagcggctggacgtgctgctggagaagctcggcgtgatctatcccggcgtcgacatccgctcccacgtcatcggtgatccgatcaccatcacctgggagagcgagccgcatttcatgggcgcgttcaagtccaatctgccgggccagtaccgctaccagcgcaggctgttcacgcagttcatgcagcgcgggctgccgcgggcccagcgcggcttcttcctgtgcggcgacgacgtgtcctggacggcgggcttcgcggagggcgcggtcacgacggcgctgaacgcggtgtggggcgtactggaccacctgggcggggccacgccgcccggcaaccccggccccggcgacctcttcgacgcgctggctcccctcgacctcccctacgacagctga

SEQ ID NO: 59 - protein, 231 aa, Streptomyces aizunensis
MIEELLPEGAVASEAFGPDGSALLYPEEAALVAMTTDLRREEFATVRACARRALAALGLPSAPVLPGVRNVPQWPDGVVGSMTHCAHYRAAVLARDTDLAMIGIDAEPDLPLPEGVLESIALPRELAWARSGGYGSSLRRDRLLFSAKEAVYKTWYPLLGTELDFDDADITFRHEVGPNGRPQGTFTARILRPLPGPDGRPVDRFTGRWLSDRGIIVTVITLPAYRVATTR

SEQ ID NO: 60 - DNA, 696 bp, Streptomyces aizunensis
atgatcgaggaactgctccccgaaggggcggtcgcgagcgaggccttcgggccggacggatcggcgctgctctaccccgaggaggcggcgctggtcgccatgacgacggatctgcgccgcgaggagttcgccaccgtccgggcgtgtgcgcggcgcgccctcgccgcactggggctgccgtctgctcccgtactgcccggggtgcgcaatgtgccccagtggcccgacggcgtggtcggcagcatgacccattgcgcccactaccgggccgccgtcctggcgcgggacacggacctggcgatgatcggcatcgacgccgaacccgatctgcccctgcccgaaggggtgctggagtcgatcgcgctgccgcgcgagctggcctgggcgcgctcgggaggatacggctccagcctgcgccgggaccgtctgctcttcagtgccaaggaagcggtctacaagacctggtacccgctgctgggcaccgagctggacttcgacgacgccgacatcaccttccgccacgaggtcggcccgaacggccggccgcagggcacgttcacggcccgcattctgcgtccgctgcccggtcccgacgggcggccggtggacaggttcacgggccgctggctttcggaccgcggcatcatcgtcacggtcatcaccctgcccgcctatcgcgtggcgaccacgcggtaa

SEQ ID NO: 61 - protein, 306 aa, Streptomyces aizunensis
MSHTPPDHVTAEAGPRLLAVSDLHIGMADNRPITESLRPSHEDDWLIVAGDVGELTEDIEWALRLLAGRFAKVVWAPGNHELWTPREDTVQLRGEERYRYLVEMCRGLGVVTPEDPWPVWEGPGGPVAVAPLFLLYDYTFRVAGTSTKEESLARAHEAGVVCTDEYLLHPDPYRSRDDWCRARVSATRRRLVAHDPSVPLVLVNHFPLVREPTDVLWHPEFAQWCGTVLTADWHRRFSTAAVVYGHLHIPRTTWYDGVRFEEVSIGYPREWRRRGHPRGLLRQILPYTPEPEPETPARTEPQETRA

SEQ ID NO: 62 - DNA, 921 bp, Streptomyces aizunensis
atgtcgcacacaccgcctgaccacgtcaccgcggaggccggtccccggctgctcgcggtgagcgatctgcacatcgggatggccgacaaccggcccatcaccgagtcgctgcgcccctcccacgaggacgactggctgatcgtggccggggacgtcggcgagctgaccgaggacatcgagtgggcgctgcgcctgctggccgggcggttcgccaaggtcgtgtgggcgccgggcaaccacgagctgtggaccccgcgcgaggacacggtgcagttgcgcggcgaggagcgctaccggtacctggtggagatgtgccgggggctgggcgtggtcacgcccgaggacccgtggccggtgtgggagggtcccggcggcccggtcgcggtcgctccgctgttcctgctgtacgactacacgttccgggtggcgggcacctcgaccaaggaggagtcgctggcccgggcgcacgaggcgggtgtggtgtgcacggacgagtacctgctccaccccgacccgtaccggagccgtgacgactggtgccgggcccgtgtctccgcgacccggcggcggctggtggcgcacgatccgtcggtgccgctggtgctggtcaaccacttcccgctggtgcgcgagcccacggacgtgctgtggcacccggagttcgcgcagtggtgcggcacggtgctgaccgccgactggcaccgccggttcagcacggccgccgtggtgtacgggcacctgcacatccccaggaccacctggtacgacggggtccggttcgaggaggtgtcgatcggctacccgcgcgagtggcgccggcgcggccatcccagggggctgctgcggcagatcctgccgtacaccccggaaccggaaccggagacccccgccaggaccgaaccgcaggagacacgggcatga

SEQ ID NO: 63 - protein, 998 aa, Streptomyces aizunensis
MGKAFAAVLVERDEQIGRLTSFVSGTASGAVAAAAAGTGRIAVIDGPVASGKTALLHRVLELTAGAGPRVITAVTSPAEQSMPFGVVEQLVRDAQAVSDRLPLHPSAGPDAALDSTPRPESEPVPAEILMAFHLQLAEVCARGPVLIVVDDVQYADPQSLYCLAHMLLRASASGAVVSLLVSRGPDVGGTPPVVLEELLYQLRGLHVRLGPLSVDGVGRLLAARDPEAGARKPAAPASWSTPLAASVHAATGGNPLLVHGLIEDRLSRQRLLAAGPGAGPASAEAGNGTGNETEDALAGTPHAGDQFLQSALICVHRTGSDGLRVAQGIALLGGAGSTSLLARLVEVEEWTVEQVVTALNEAGVLEKSVFRHGGVQTAVVESLTDEAATRLRQRAAVLLYEDGAAPLTIAAQLLSHEMSAPDEEWVPRVLSEAARAALCTQQVEFAVRCLRMAESCCRDETERMLLRAHLAKYIWRVQPSAWPQQLRPLLGAVRDGLLPPVDTVRLVYDLLWNGWMDDAAAAIRQVVDVLHRSPDARLATELGALRLALASTYPAVLEHLGDVPAPARGAGERLSAQEEILLTSARVLHGVLRGGDGARDTDPDTDAEDFAESAERTLAGTRLTEETHLGLRACLLTLFYADRPATATLWADRLLVEAADRKAPGWTAVLRAIRAHMSLRRGHLVEARRLAEQALDQLPPHGWGVGIGMPLSALIEARTAMGDHEAAAELLDRPVPEDMLTTRHGLHYLYARGRHQLATGRHHAALTDFTACGELMRRWGMDRSTLVPWRVGVAEARLALGSREEAERFAREQLAGDAGQRVRGHALRVLAAARPLRERPALLAQAVALLQEDSDWYELARALTDLGQAYKQLGDPSQGKVHTRRAWRIAKGCGARELYRSLHPSQPPAPSAPAAQPRPAAPADAARPPSAAVSSLTDAERKVAALAAHGYTNREIGAKLFITVSTVEQHLTRVYRKINITHRQDLPVSLDTDVAHTA

SEQ ID NO: 64 - DNA, 2997 bp, Streptomyces aizunensis
atggggaaggcttttgcagctgtgttggtggagcgagatgaacagatcggaagactgacctccttcgtatccggcaccgcttccggcgcggtggccgcggccgccgccgggaccggccggatcgccgtgatcgacgggccggtggcttcgggaaagacggcgctcctccatcgcgtgctggagctgacggccggggcggggccacgcgtcatcaccgcggtcacctcgcccgcggaacagtccatgccgttcggcgtggtggagcagctggtgcgcgacgcgcaggccgtctccgaccggctgccgctccacccgtcggccggaccggacgcggcgctggactcgacgccgcggccggagtcggagccggtacccgccgagatcctcatggccttccacctccagctcgccgaggtctgcgcgcgcgggccggtcctgatcgtcgtcgacgacgtgcagtacgccgacccgcagtcgctgtactgcctcgcccacatgctgctccgggcgtccgcctccggcgccgtggtgtcgctgctggtgagccgcggcccggacgtgggcggcacgccgcccgtcgtcctggaggaattgctctaccaactgcggggcctgcacgtccggctgggtccgctcagtgtcgacggcgtcggccggctgctcgcggcccgggacccggaggccggagcgaggaagcccgcggcccctgcctcgtggtccaccccgctggccgcctccgtccacgcggcgaccggcggcaaccccctgctcgtccacgggctcatcgaggaccgcctcagccgacagcgactcttggcggccggccccggtgcgggccccgcgtcggccgaggccgggaacgggaccgggaacgagaccgaggacgccctcgcgggaacgccccacgcgggcgaccagttcctgcagagcgcgctgatctgtgtgcaccgcacgggatccgacggcctgcgggtcgcccagggcatcgccctgctgggcggcgccggatcgacgtcactgctcgcccggctcgtggaggtcgaggagtggaccgtggagcaggtggtcaccgccctcaacgaggcgggcgtcctggagaagtccgtattccggcacggcggcgtgcagaccgcggtggtggagagcctgaccgacgaggcggcgacgcggctgcgccagcgggcggccgtgctgctgtacgaggacggggcggcgccgttgaccatcgcggcccaactgctcagccatgagatgagcgcccccgacgaggaatgggtgccgcgggtgctgagcgaggccgcgcgtgcggcgctgtgcacgcagcaggtcgagttcgcggtgcgctgtctgcggatggcggagagctgctgccgcgacgagacggagcggatgctgctgcgggcgcatctggccaagtacatctggcgggtccagccgtccgcgtggccgcagcagctgcgtccgctgctgggggcggtacgggacggcctgctgccccccgtcgacacggtgcggctggtctacgacctgttgtggaacggctggatggacgacgcggccgccgcgatccgccaggtcgtcgacgtactgcaccggtcccccgacgcccggctcgccaccgagctcggagccctgcggctcgccctggccagcacgtatccggcggtgctcgaacacctgggggacgtaccggccccggcgcggggcgcgggcgagcgtctgtcggcgcaggaggagatcctgctgacctcggcgagggtgctgcacggtgtgctgcgcggcggcgacggggcgcgggacacggacccggacacggacgcggaggacttcgccgagagcgccgagcggaccctggccggcacgcggctgacggaggagacccacctcgggctgcgcgcgtgcctgctgacgctcttctacgcggaccggccggccacggcgacgctgtgggccgaccggctgctggtggaggcggcggaccgcaaggcgccggggtggaccgcggtgctgcgggcgatccgcgcgcacatgtccttgcgccggggtcatctggtggaggccaggcggctggcggagcaggcgctggaccagctgccgccgcacgggtggggcgtgggcatcgggatgccgctgtcggccctcatcgaggcgcggacggcgatgggcgatcacgaggcggcggcggagctgctggaccgcccggtgccggaggacatgctcacgacgcgccacgggctgcactatctctacgcgcgtggccggcaccagctggccacgggacgccatcacgcggcgctgaccgacttcacggcctgtggcgagctgatgcggcgctggggcatggaccgttcgacgctggtgccctggcgggtcggcgtcgccgaagcccggctggcgctgggcagccgcgaagaggcggaacgtttcgccagggagcagctcgccggggacgccggtcagcgggtgcgcggacacgcgctgcgggtgctcgcggcggcccgtccgctgcgcgagcgtccggcgctgctcgcgcaggcggtcgcgctgctccaggaggacagcgactggtacgagctggcgcgggcgctgaccgatctcgggcaggcgtacaagcagctcggcgacccgtcccagggcaaggtgcacacccgcagggcgtggcggatcgccaagggctgcggcgcccgggagctgtaccgctccctgcatccgagccagcccccggcgccctcggcgcccgccgcgcagccgcgccccgccgccccggccgatgccgcgcgccccccgtccgccgcggtgtcgtcgctgacggacgcggagcgcaaggtggcggcgctggcggcgcacggttacaccaaccgggagatcggggccaagctcttcatcaccgtcagcacggtcgagcagcatctgacccgggtctaccggaagatcaacatcacgcaccgccaggacctgccggtcagtttggataccgatgtcgcacacaccgcctga

SEQ ID NO: 65 - protein, 518 aa, Streptomyces aizunensis
MTTTVIGKVAELYAVREEAVRGPSDRATEAQHAKGKLTARERIGLLLDEGSFREVEQLRRHRASGFGLEAKRPYTDGVITGWGTIEGRTVFVYAHDFRIFGGALGEAHATKIHKIMDMAIAAGAPLVSLNDGAGARIQEGVSALAGYGGIFQRNTKASGVIPQISVMLGPCAGGAAYSPALTDFVFMVRETSQMFITGPDVVKAVTGEEITQNGLGGADVHAGTSGVAHFAYDDEETCIAEVRYLLSMLPSNNRENPPAVQAGDPADRRCDALLNLVPVDGNRPYDMLKVIEEIVDDGDYVEIHEGWSRNIICALARLDGQVVAIVANQPQFLAGVLDIGASEKAARFVQMCDAFNIPIVTLLDVPGFLPGVDQEHGGIIRHGAKLLYAYCNATVPRISLILRKAYGGAYIVMDSQSIGADLTYAWPTNEIAVMGAEGAANVIFRRQIAESGDPEAMRARMVKEYKAELMHPYYAAERGLVDDVIDPAETREVLIASLAMLRTKHADLPPRKHGNPPQ

SEQ ID NO: 66 - DNA, 1557 bp, Streptomyces aizunensis
atgacgacgaccgtcatcgggaaagtggccgagctgtacgccgttcgtgaggaggcggtgcgtgggccgagcgaccgggcgacggaggcgcagcacgcgaagggaaagctgaccgcccgtgagcggatcggccttttgctggacgagggttcgttcagggaggtcgaacagctgcggcggcaccgggccagcggtttcggcctggaggcgaagaggccttacacggatggtgtgatcaccggttggggcaccatcgagggccgtacggtcttcgtctacgcgcacgacttccgcatcttcggcggggcgctgggcgaggcccacgccacgaagatccacaagatcatggacatggcgatcgccgcgggtgctccgctggtctcgctgaacgacggcgcgggcgcccgtatccaggagggcgtctcggcgctggccggttacggcggcatcttccagcgcaacaccaaggcgtccggggtcatcccgcagatcagtgtgatgctcggcccgtgcgcgggcggcgcggcctattcgccggcgctgacggacttcgtgttcatggtccgtgagacctcgcagatgttcatcaccggtccggacgtggtcaaggccgtcaccggcgaggagatcacgcagaacgggctcggcggcgcggacgtgcacgccgggacctcgggcgtcgcgcacttcgcgtacgacgacgaggagacctgcatcgcggaggtccgctatctgctgtcgatgctcccctccaacaaccgggagaacccgcccgccgtccaggccggggacccggccgaccggcgctgcgacgccctgctgaacctcgtaccggtggacgggaaccgtccgtacgacatgctcaaggtcatcgaggagatcgtcgacgacggcgactacgtcgagatccacgagggctggtcccgcaacatcatctgcgcgctggcccgtctggacggccaggtggtcgccatcgtcgccaaccagccgcagttcctggccggcgtgctggacatcggggcatcggagaaggccgcgcgcttcgtgcagatgtgcgacgccttcaacatcccgatcgtgacactgctcgatgtgcccggcttcctgccgggcgtcgaccaggagcacggcgggatcatccggcacggcgcgaagctgctgtacgcgtactgcaacgcgaccgtgccgcggatctccctgatcctgcgcaaggcgtacggcggcgcctacatcgtcatggactcccagtccatcggcgcggacctcacctacgcctggccgaccaacgagatcgcggtgatgggcgccgagggcgccgccaacgtcatcttccgccggcagatcgccgagtccggggaccccgaggcgatgcgcgcgcggatggtcaaggagtacaaggccgagctgatgcacccctactacgcggccgagcggggcctggtcgacgacgtcatcgaccctgccgagacccgcgaggtgctgatcgcctccctcgccatgctccgcacgaagcacgcggacctgccgccgcgcaaacacggcaaccccccgcagtga

SEQ ID NO: 67 - protein, 329 aa, Streptomyces aizunensis
MTAHPNGVTPPLPPTETDRTLHFAGPATFGRIPRIDQVEKTDIAVVGVPFDSGVTYRPGARFGGNAIREASRTLRPYNPAQNVYPFHFSQVADAGDISANPFDLNDAVETIEAAADDLISSGARLMTLGGDHTIALPMLRAVAKKHGPLAVLHFDAHLDTWDDYFGQQYTHGMPFRRAVEEGILDTSALSHVGTRGPIYGKKDLDDDEKLGFGIVTSADVMRRGVDEVAQQLRERVGDRPLYISIDIDVLDPAHAPGTGTPEAGGLTSRELLEILRGLADCHLVSADIVEVAPAYDHADITSVAASHAAYELISIMSKQIAPVRWGATQ

SEQ ID NO: 68 - DNA, 990 bp, Streptomyces aizunensis
atgaccgcgcaccccaacggagtgaccccgccgctgccgccgacggagaccgaccggacgctgcacttcgcgggccccgcgacgttcggccgcatcccgcggatcgaccaggtggagaagaccgacatcgccgtggtcggcgtgcctttcgacagcggcgtcacctatcggccgggcgcccgcttcggcggcaacgccatccgggaggcgtcccgcaccctgcgtccctacaacccggcgcagaacgtctaccccttccacttcagtcaggtcgcggacgccggtgacatcagcgccaaccccttcgacctgaacgacgccgtggagacgatcgaggcggccgccgacgacctgatctccagcggcgcccgtctgatgacgctgggcggcgaccacaccatcgccctgccgatgctgcgtgccgtggcgaagaagcacggtcccctcgccgtcctgcacttcgacgcccatctggacacctgggacgactacttcgggcagcagtacacccacggcatgccgttccgccgcgccgtggaggagggcatcctcgacacctccgccctctcccacgtcggcacgcgcggcccgatctacggcaagaaggatctcgacgacgacgagaagctcggcttcggcatcgtcacctcggccgatgtgatgcggcgcggagtggacgaggtggcccagcagttgcgcgagcgcgtcggcgaccgtcccctgtacatctccatcgacatcgacgtcctggacccggcgcacgccccgggcaccggcacccccgaggccggcggcctcacctcccgcgagctgctggagatcctgcgcgggctcgccgactgccacctggtctccgcggacatcgtggaggtcgctccggcctacgaccacgccgacatcacctcggtggcggcgtcccacgctgcctacgagctgatcagcatcatgtccaagcagatagccccggtccgctggggtgcgacgcagtaa

SEQ ID NO: 69 - protein, 521 aa, Streptomyces aizunensis
VTPQDHWWSASQSYVSDILSVFAAAPDRPAVNWRGETASGGELIRSVTEAFHALHDSGVRAGDVVAILVAPNSPEMLTARYAAHLLGGAVCYLRSTNPGTSEVALPLDQQIRILRDTEAVTVYTDAENAPRAAELAAGASGLPVTCLTGEARKRESAEDAPRALPWAPDALALITFTSGSTGRPKGIRLAGRAWNGLVQGMVAAGGEAEGVKLLVTTPLSHTVGSMADTALALGGEVYLHENFNAEQFVNTVADEGIAWTFMATVHLFQLLDHLEERGLKDVEEGRLAPLQRLIYSGSAAAPARIAQAVKAFGLIIVQAYGTGETGRLTTLFPHEHLDPWLSTTVGRPFPDVEVVVGDQESGAPLATGEVGEVRVRSPHMMDGYTGDPAATAKVLRDGWYHTGDIGYTDEHGYLHLLGRVADVVKVNGVKVHPTVVERELLSLAGVRHAAVYGVRDQDAVEHLHATIVCDPAVPVETDAIRAHLAQSLSGLHVPEKISVVADLPLNDNGKPDKVRLQLLDS

SEQ ID NO: 70 - DNA, 1566 bp, Streptomyces aizunensis
gtgaccccgcaggaccattggtggagcgcaagccagagttacgtctcggacatcctctccgttttcgcggcggccccggaccgccccgcggtgaattggcggggcgagacggcctccggcggtgaattgattcggtcggtgaccgaggcgttccacgcactgcacgacagcggcgtgcgcgcgggcgatgtcgtggccatcctggtggcgcccaacagcccggagatgctcacggcacggtacgcggcgcacctgctcggcggcgcggtgtgctacctgcggtccaccaaccccggaaccagcgaggtggcccttccgctggaccagcagatccggatcctgcgggacaccgaggccgtgaccgtctacacggacgccgagaacgcgccgcgcgccgccgaactggccgcgggcgccagtggactgcccgtgacgtgcctgacgggtgaggcgcgcaagagggagagcgcggaagacgctccgcgcgccctgccgtgggccccggatgcactggccctcatcacgttcaccagcggcagcaccggacggccgaagggcatccggctggcgggccgggcgtggaacggcctggtccagggcatggtggcggccggcggcgaagccgagggcgtcaagctcctggtcaccaccccgttgagccacaccgtcggcagcatggcggacaccgcgctggcgctgggcggcgaggtctacctgcacgagaacttcaacgccgaacagttcgtcaacaccgtggccgacgagggcatcgcgtggaccttcatggcgacggtccatctgttccagctgctcgaccacctggaggagcgcggcctgaaggacgtcgaggaaggacgcctggccccgctgcagcggctcatctacagcggcagcgcggcggcgcccgccaggatcgcccaggccgtgaaggccttcggtctcatcatcgtgcaggcgtacggcacgggagagaccggccggctcaccaccctcttcccgcacgagcacctggacccgtggctctcgaccaccgtcgggcggcccttccccgatgtggaggtcgtcgtcggcgaccaggagtcgggcgcgccgctcgccaccggcgaggtcggcgaagtccgcgtgcgctccccgcacatgatggacggctacaccggggacccggcggccaccgcgaaggtcctgcgcgacggctggtaccacaccggcgacatcggctacaccgacgaacacggctatctgcacctgctgggccgggtcgccgacgtggtcaaggtcaacggcgtcaaggtccacccgacggtggtcgaacgggagctcctctcgctcgcgggcgtccggcacgccgcggtgtacggcgtgcgggaccaggacgccgtggagcacctgcacgccacgatcgtgtgcgacccggcggtgccggtggagaccgacgccattcgcgcgcacctcgcccagtccctctccgggctgcacgtgcccgaaaagatcagcgtcgtcgccgatctgccgctgaatgacaacggaaagcccgacaaggtgcggctgcagctgctcgactcctga

SEQ ID NO: 71 - protein, 410 aa, Streptomyces aizunensis
MNLHLESYSTGVTAKELAERRREFLEIGRRSGHFPSASARQDGVDSQISVWCSNDYLGMGQNPQVIEAMKKTIDTHGVGSGGSRNIGGTNHYHVLLEAELADLHGKEAALLFTSGYTANDGSLSVLAGTPKDTIVFSDEKNHASIIDGLRHSGAQKHIFRHNDVAHLAELLAAAPADRPKLIVLESVYSMSGDIAPLAEIAELARRYDATTYIDEVHAVGMYGPQGAGIAAREGIADQFTVVMGTLAKGYGTVGGYIAGPAALVDAVRTLSRAFVFTTSLPPAVAAGALEAVRYLRNSDVERKVLAENAQLLHRLLDEADIPFISPDSHIVSAFIGDDETCKQASRLLFERHGIYVQSINAPSVPLGQEILRIAPSTVHGREDVENFAEALRGIWKELNIPTATDRNWLS

SEQ ID NO: 72 - DNA, 1233 bp, Streptomyces aizunensis
atgaacctgcacctggaatcgtattcaaccggcgtgaccgccaaggaactcgccgagcggcggcgtgaattcctggagatcggccgccgctccggacacttccccagcgccagcgcgcgccaggacggcgtggactcccagatcagcgtctggtgcagcaacgactacctcggtatggggcagaacccccaggtcatcgaggcgatgaagaagaccatcgacacccacggcgtgggctccggcggctcgcggaacatcggtggcaccaaccactaccacgtgctgctcgaagcggagctggcggacctccacggcaaggaggcggcgctcctcttcacctccggctacacggccaacgacggttccctgagcgtcctggccgggacgcccaaggacacgatcgtcttctccgacgagaagaaccacgcgtcgatcatcgacgggctgcggcacagcggcgcgcagaagcacatcttccggcacaacgacgtcgcgcacctggcggagctgctcgcggccgcccccgccgaccgtccgaagctgatcgtccttgagtcggtctattcgatgtcgggcgacatcgcgccgctggccgagatcgccgagctcgcgcgccgctacgacgccaccacgtacatcgacgaggtgcacgcggtcggcatgtacggtccgcagggcgccggcatcgccgcccgtgagggcatagccgaccagttcaccgtcgtgatgggcacgctggccaagggctacggcaccgtcggcggctacattgccggtcccgccgccctcgtcgacgccgtgcgcaccctgtcgcgcgccttcgtcttcaccacctcgctgccgccggccgtcgcggcgggtgcgctggaggccgtgcgctacctccggaactccgacgtcgagcggaaggtgctggcggagaacgcccagctgctgcaccggctgctcgatgaggccgacatcccgttcatctcgccggactcgcacatcgtctccgccttcatcggggacgacgagacctgcaagcaggcgtcccggctgctcttcgagcggcacgggatctacgtccagtccatcaacgcccccagcgtgccgctcggccaggagatcctgcggatcgcgccgtccacggtgcacgggcgcgaggacgtcgagaacttcgccgaggccctccgcgggatctggaaagagctgaacatcccgacggccaccgacaggaactggctttcgtga

SEQ ID NO: 73 - protein, 506 aa, Streptomyces aizunensis
VTRSVAAVLAESAGRWPSRTALVCGAERISYARLWDRARRYAAALRGQGIGPDDKVALLMPNTPEFAAVYFAVLALGAVVVPVHTLLKPAEVSHLLRDSGARALVWAGTLPQETARDAGETGVLLLTVGEALHGSVLLDDGVEPIDTYVERGADDLALVLYTSGTTGRPKGAMLTHGNVATNIAVTAVSPFAFGEDDVLLGALPLSHTFGQICGMAVTFHAGATLVVMERFEAHDALRLMREHGCTVFMGVPTMYHALLEAVAAGAPAPRLTRVYSGGSALPVPVLDRVRAAFGCEVYEGYGLTETSPCVAYNQPGIPCKPGTVGLPIDGVRVAIADAELEGRIRLLKQGDIGEIVVSGHNVMAGYLGRPQETAEVLVDGWFRTGDMGVQDEDGYLSIVDRKKDMIVRGGYNVYPREVEDVLLRHPAVDGACVVGVPSVKHGEEVCAVVRVKPGQRASGLLAEEIVAWSRVHMAAYKYPRRVEFVETFPLGSSGKVLKRELAHRYA

SEQ ID NO: 74 - DNA, 1521 bp, Streptomyces aizunensis
gtgacccggtcggtggcggccgtcctcgcagagtccgcggggcggtggccatcccgcaccgccctggtgtgcggggcggagcggatctcgtacgcgcgtctgtgggaccgggcccgccggtacgccgccgccctgcgcggccagggcatcggccccgacgacaaggtcgcgctgctgatgccgaacaccccggagttcgcggcggtgtacttcgcggtgctcgcgctcggcgccgtcgtcgtcccggtccacaccctgctgaagcccgcggaggtctcgcatctcctccgggactcgggagcgcgggccctcgtatgggccgggacgctcccgcaggagaccgcacgggacgccggggagaccggggtcctgctcctgaccgtgggggaggccctgcacggctccgtcctcctcgacgacggcgtcgagcccatcgacacgtatgtcgagcggggggcggacgacctcgcgctggtgctgtacacctccggtacgacgggcaggccgaagggggcgatgctcacgcacggcaacgtcgcgacgaacatcgccgtgaccgccgtgtcccccttcgccttcggcgaggacgacgtgctgctcggcgcgctgccgctgtcgcacaccttcggccagatctgcgggatggccgtcaccttccacgcgggcgcgacgctggtggtcatggagcgcttcgaggcgcacgacgccctgcggctgatgcgcgagcacggctgcacggtcttcatgggcgtgccgaccatgtaccacgcgctgctcgaagcggtcgcggccggcgccccggcgccgcgcctcacccgcgtgtacagcggtgggtcggctctgccggtgccggtgctcgaccgggtgcgggcggcgttcggctgcgaggtgtacgaggggtacgggctcaccgagacctcgccctgcgtggcgtacaaccagccgggcatcccctgcaagccgggcacggtggggctgcccatcgacggcgtacgggtcgccatcgccgacgcggagctggaaggacgcatcaggctgctgaagcagggcgacatcggcgagatcgtcgtgagcggacacaacgtgatggcgggctacctcggccggccgcaggagaccgccgaggtactggtcgacggctggttccggaccggggacatgggcgtgcaggacgaggacggctatctgtccatcgtcgaccggaagaaggacatgatcgtccgcggtggctacaacgtctacccccgcgaggtggaggacgtactgctgcgccatcccgccgtggacggcgcctgcgtggtcggcgtgccgagcgtgaagcacggcgaggaggtgtgcgccgtggtccgggtgaagcccggtcagcgcgcgagcggtctcctcgcggaggagatcgtggcctggagccgggtgcacatggcggcctacaagtacccgcgccgcgtcgagttcgtggagaccttcccgctgggatcgagcggcaaggtcctcaagcgggagctggcacaccgctacgcgtga

SEQ ID NO: 75 - protein, 217 aa, Streptomyces aizunensis
VPTRTVEEDIEIVLIVRDDMRRYGVEGMCRSLDTPVEAQSYADFDDLDPFSGGQLVILSSDAAGPLSAETAESLRTHEIPVLILVDSAAPVEQSWADQARGFLDWADLRPDTLRDAIADVAAGRFFASETLARRSVTAAEQTEGGTPAARSPITLTARELQVLRLIAGGLSNRQIARSLNISEHGVKRLVGIVLAKLNCPNRTLAVVRAIDAGLLTL

SEQ ID NO: 76 - DNA, 654 bp, Streptomyces aizunensis
gtgccgacccgcactgttgaggaagacatcgagatagtcctgatcgtccgcgacgacatgcggcgctatggcgtcgagggaatgtgccgttcgctggacacccccgtcgaggcgcagtcctacgcggatttcgatgatctcgaccccttctccggaggccagttggtcatcctctccagtgatgcggcgggtcccctctccgccgagaccgccgaaagcctgcggacgcatgagatacccgtgctgatcctggtcgactcggccgccccggtcgagcagtcctgggccgaccaggcgcgcggcttcctggactgggcggatctgcgccccgacaccttgcgcgacgcgatcgccgatgtggcggccgggcgcttcttcgcgtcggagaccttggcgcggcgctccgtgacggcggcggagcagacggagggcggaacgcccgcggcgcggagcccgatcacgctgacggcgcgtgaactccaggtcctgcgcctgatcgcgggcggtctgagcaatcggcagatcgcgcggtcgctgaacatctccgagcacggtgtcaaacgcttggtcgggatcgtcctggccaagctcaactgtccgaaccgcacgctcgccgtggtccgtgccattgacgcgggtctcctcaccttgtga

SEQ ID NO: 77 - protein, 442 aa, Streptomyces aizunensis
MTKNQEPRDPSGTRPRKAAASGKPSLHHAVPPTGPGGPPAAADSQITLRSPAELADALPYMLGFHPTDSLVMVALHGEGGRFGGRLRVGIPTDRGEWEDTARQVADCLVHGSERRGGKPDGIVVFLCQDPRGGESGQRVMTRLRPLAQRIRLACGALDVPVLEALCLSGGRYWSYCCPDARCCPAEGTALTVPGTSVMAAAATYAGLRVRGSLQEIEGRLAPLRGPLADEQERSLDLAATALVPKILDGATREDVGADTLELARTLMRRLTLAPPADGGPCAEDWDDALLGHDEAASLILGLQDREIRDIAAEWMEGEEAAPALRLWRALARRCVGAYGEHAAAPLTLAGWVSWSTGDEPTARIALGMALRADADYRFAQLLHHACNEGIDPEGLRECLRAERGRREPRRARAAAVTRPPGRRPRTTRPAPRDRRRTAGSEQ

SEQ ID NO: 78 - DNA, 1329 bp, Streptomyces aizunensis
atgacgaagaaccaggaaccacgcgacccgtccggtacccggccccgtaaggcggcggcgtccggcaagccctccctccaccacgcggtgccccccacggggccgggcggcccgccggcggccgccgactcacagatcaccctgcgcagcccggccgaactggccgacgccctgccctacatgctcggcttccacccgaccgactccctcgtcatggtcgccctgcacggcgagggaggccgcttcggcggccggctgcgggtcggcattcccaccgaccggggggagtgggaggacaccgcccggcaggtcgccgactgcctggtgcacggcagcgaacggcgcggcggcaagcccgacggcatcgtcgtcttcctctgccaggacccgcgcggcggggagagcgggcagcgggtgatgacccggctgcgcccgctcgcccagcgcatcaggctcgcctgcggagcgctggacgtgcccgtgctggaggcgctgtgcctctccggcggccggtactggtcctactgctgccccgacgcgcggtgctgcccggccgaagggaccgccctgaccgtgcccggaacctcggtgatggcggccgccgccacctacgccggactccgggtcaggggttcgctccaggagatcgagggccgcctggcgcccctgcgcggaccgctcgccgatgaacaggagcggtccctggacctggccgccaccgcgctcgtaccgaagatcctcgacggagccacccgggaggacgtgggcgcggacaccctggaactcgcccggaccctgatgcggcgcctcaccctcgccccgcccgccgacggcgggccctgcgccgaggactgggacgacgcgctcctcggacacgacgaggcggcctccctcatcctcggcctccaggaccgcgagatcagggacatcgccgcggagtggatggagggcgaggaagccgccccggcgctgcgtctgtggcgcgccctcgcccggcgctgcgtcggcgcctacggagagcacgcggccgccccgctgaccctggcgggctgggtgtcctggtccaccggtgacgaaccgaccgcccgcatcgccctgggaatggccctgcgggccgacgccgactaccgcttcgcccaactcctccaccacgcctgcaacgaaggcatcgacccggagggactgcgggagtgcctgcgcgcggagcggggacggcgggagccgcgccgcgcccgggcggccgccgtcacccggccgccggggcggcgtccccggaccacccgccccgcaccccgtgaccggcgccgcacggcggggagcgagcagtga

What is claimed is:

1. An isolated compound of the formula:

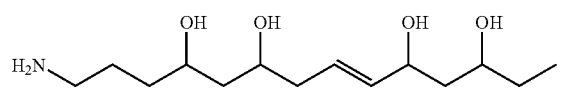

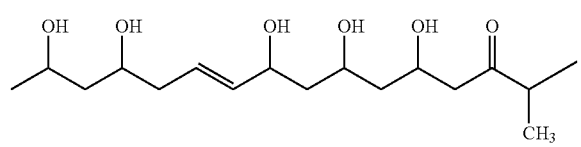

-continued

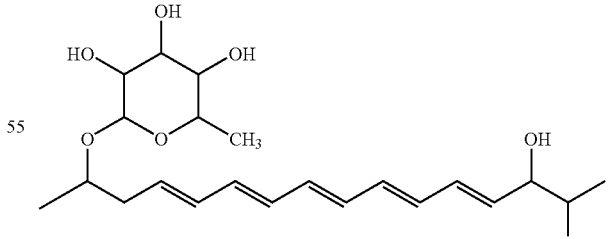

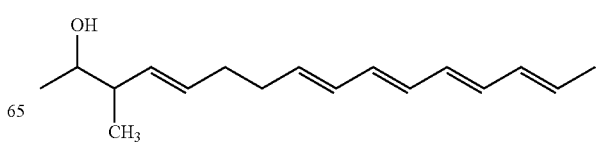

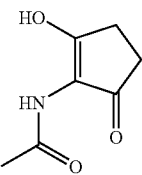

or a pharmaceutically acceptable salt thereof.

2. An isolated compound of the formula II:

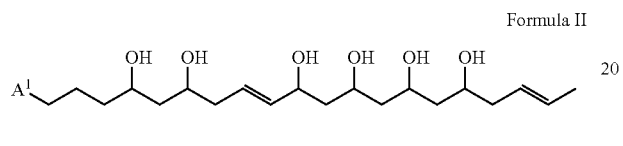

Formula II

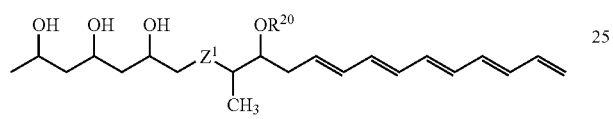

wherein $A^1$ is —$NH_2$, —N=CH—$R^{13}$, an amino acid or —NH—$R^{14}$, wherein $R^{13}$ is hydrogen or phenyl, wherein the amino acid is attached via its nitrogen atom, and wherein $R^{14}$ is selected from the group consisting of isopropyl, 1-(4-nitrophenyl)methyl, cyclohexyl,

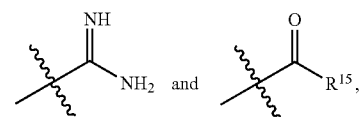

wherein $R^{15}$ is selected from the group consisting of methyl, isopropyl, phenyl, 4-nitrophenyl, 1-aminoethyl, 1-amino-1-(4-hydroxyphenyl)methyl, 1-amino-2-(4-hydroxyphenyl)ethyl, 1-amino-2-methylpropyl, 2-pyrrolidinyl and 1-amino-2-hydroxyethyl;

$Z^1$ is selected from the group consisting of:

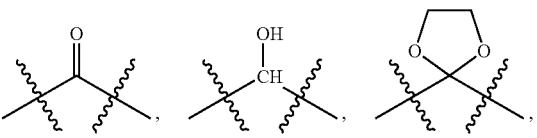

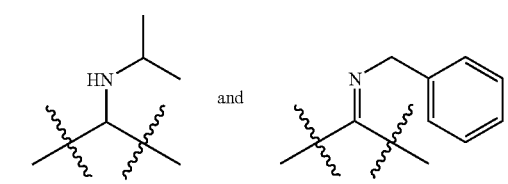

$R^{20}$ is selected from the group consisting of hydrogen and

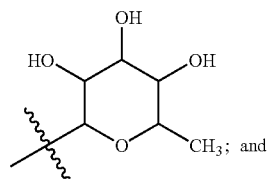

$D^1$ is hydroxy, methoxy or

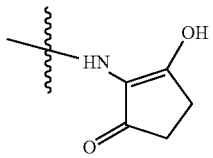

and pharmaceutically acceptable salts thereof.

3. An isolated compound selected from the group consisting of:

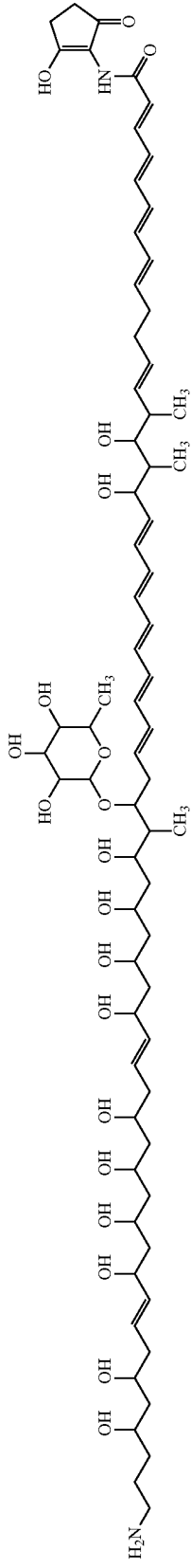
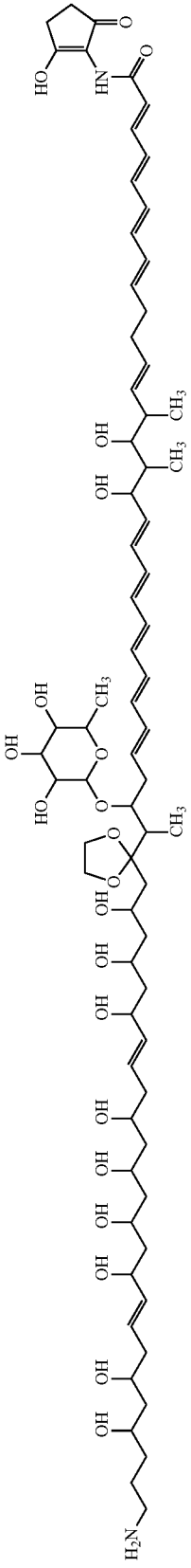
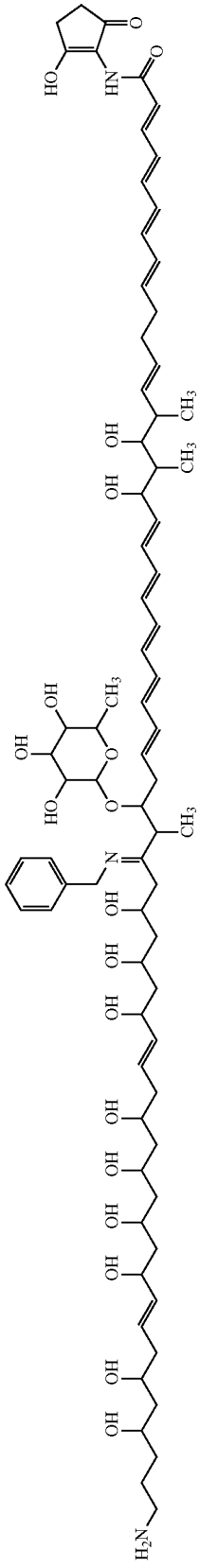
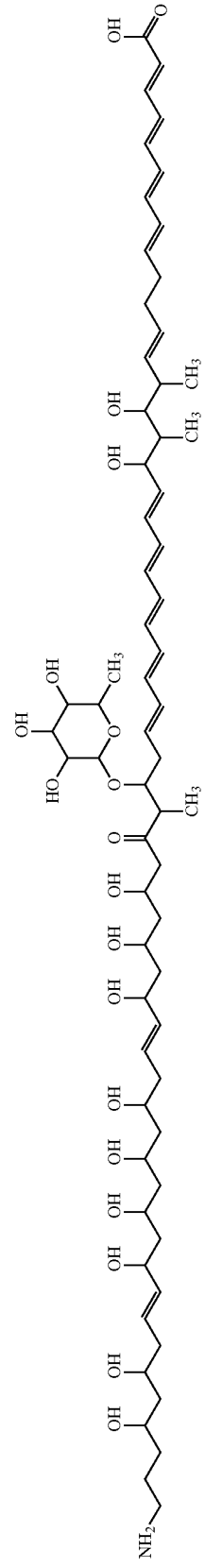

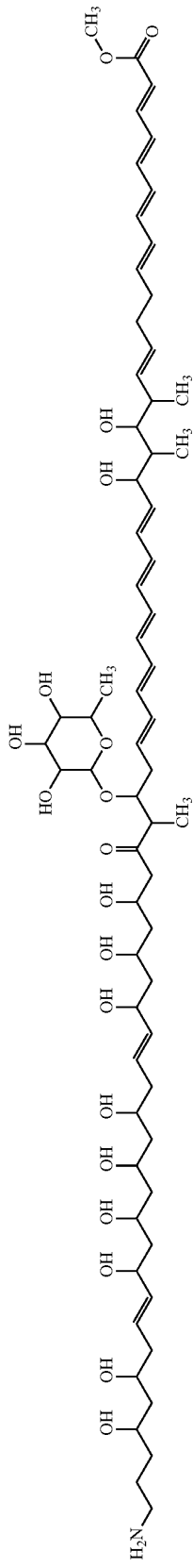
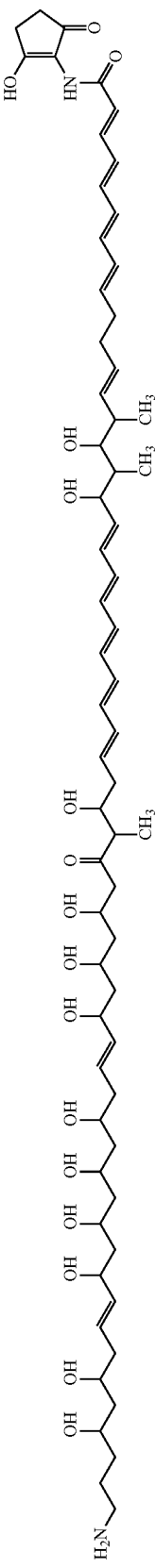
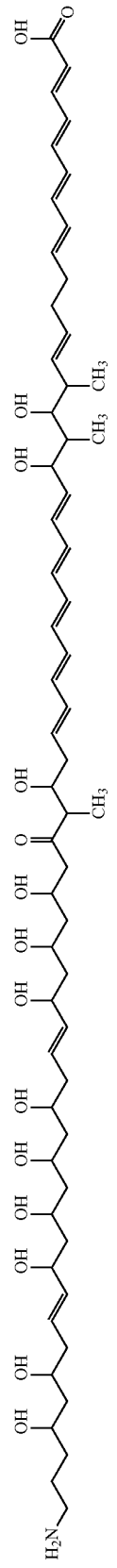
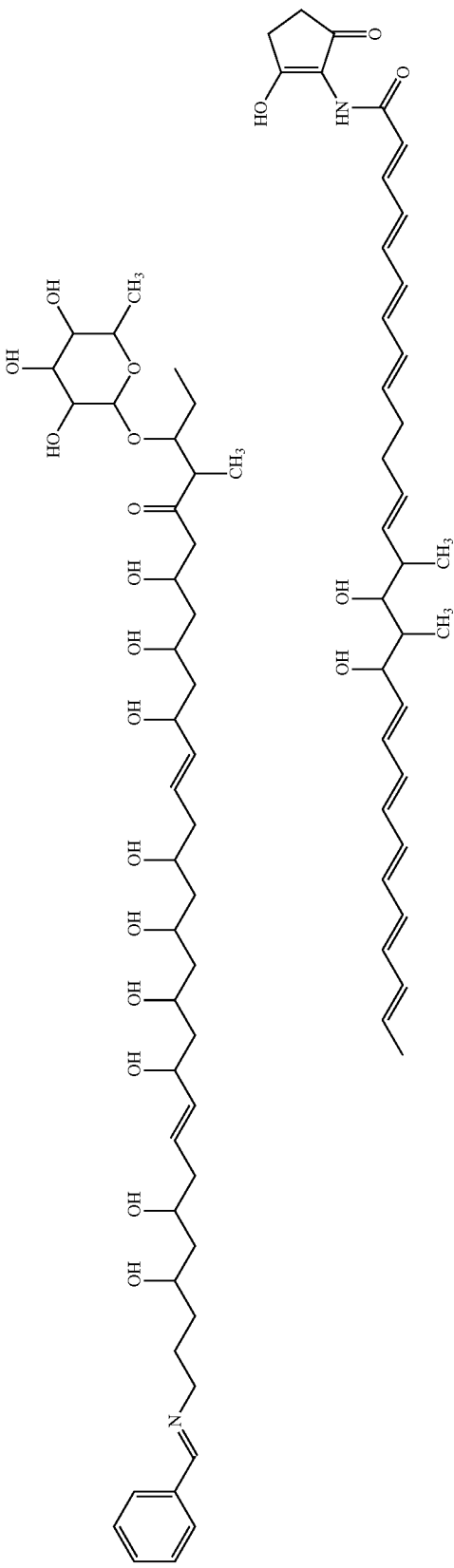

Compound 2(o)
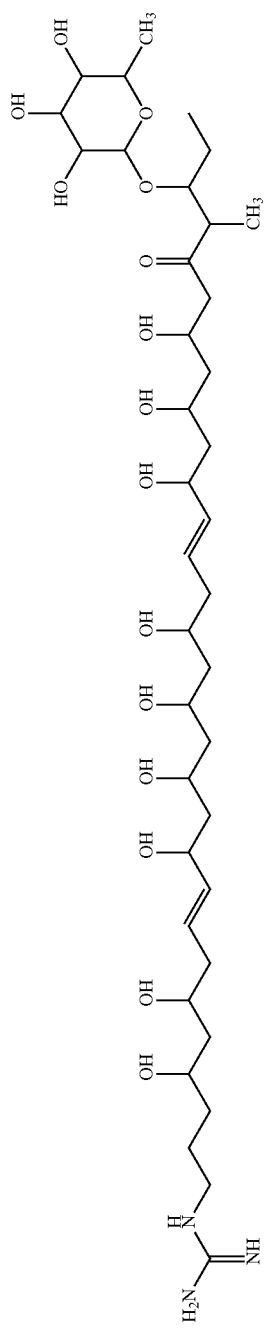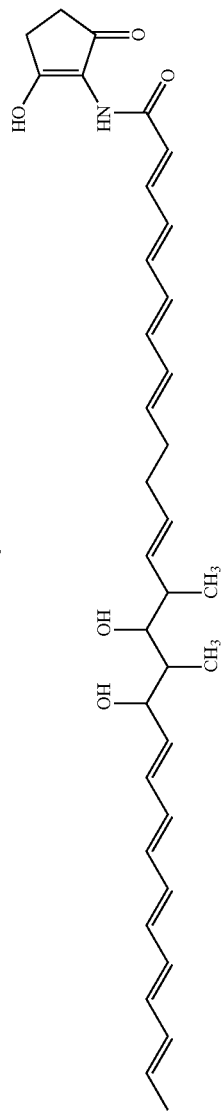
Compound 2(p)
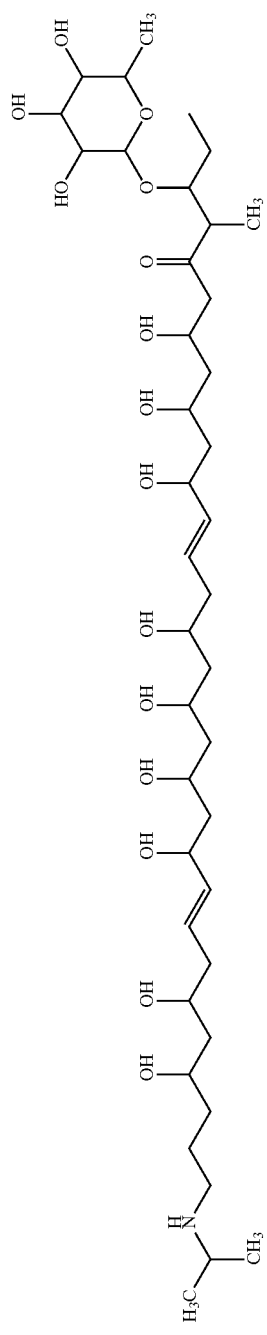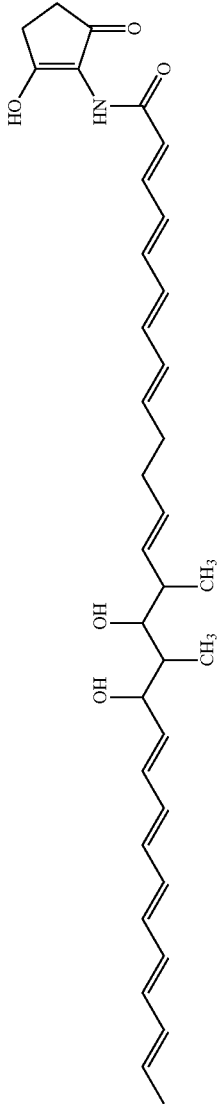

-continued
Compound 2(q)
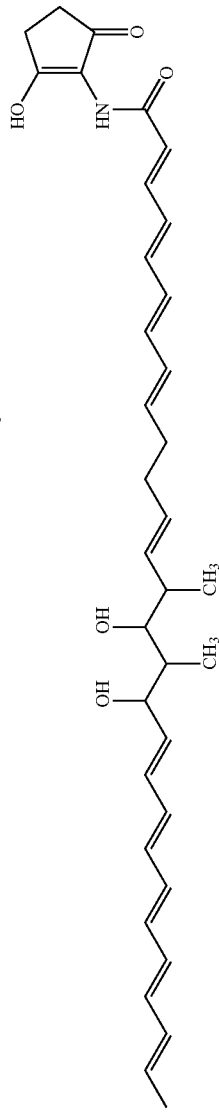
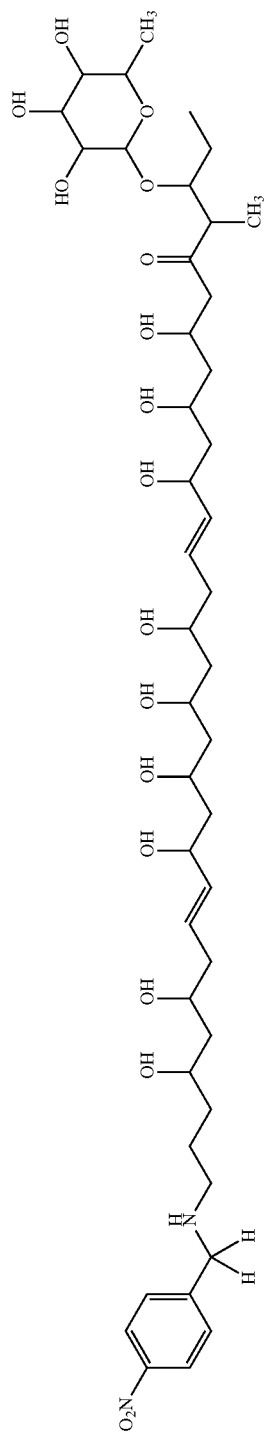
Compound 2(r)
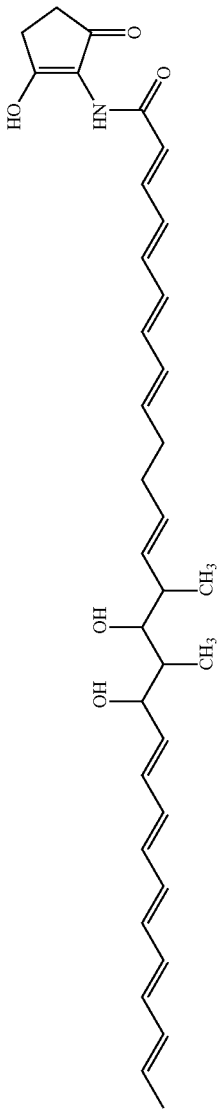
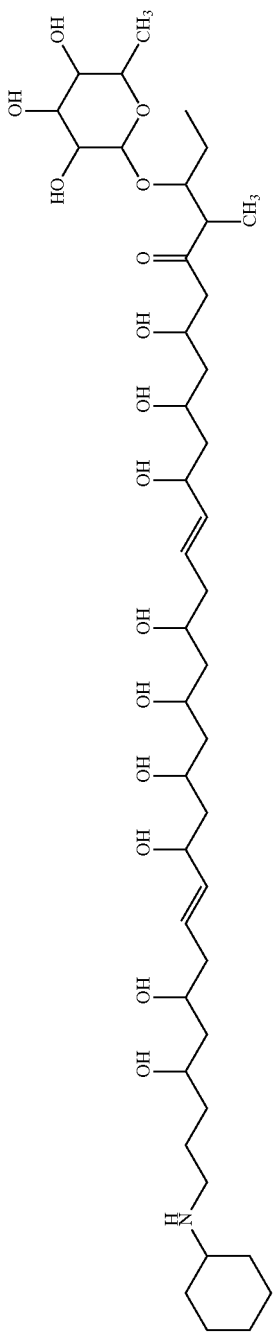

-continued
Compound 2(s)
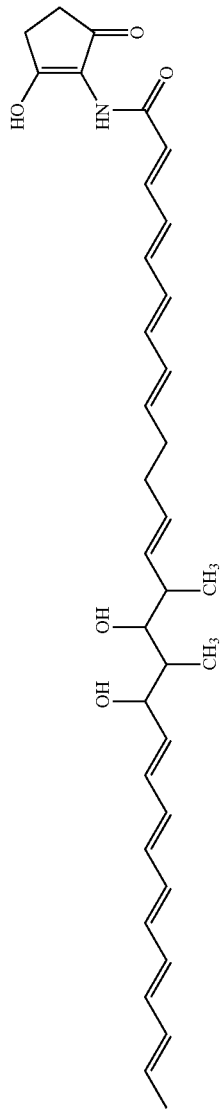
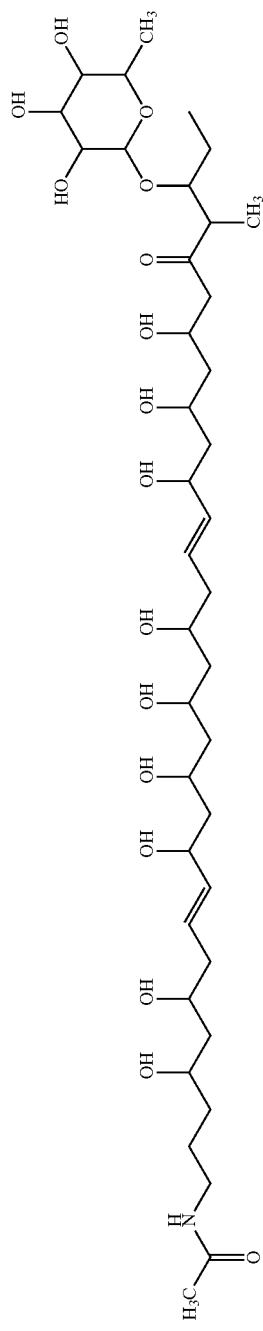
Compound 2(t)
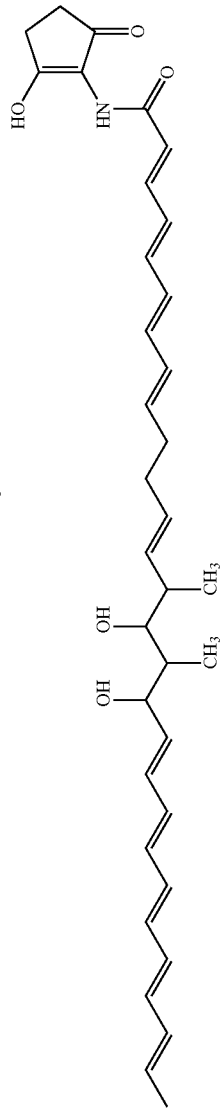
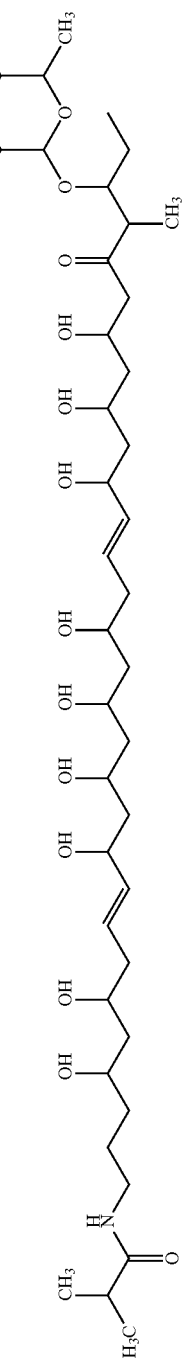

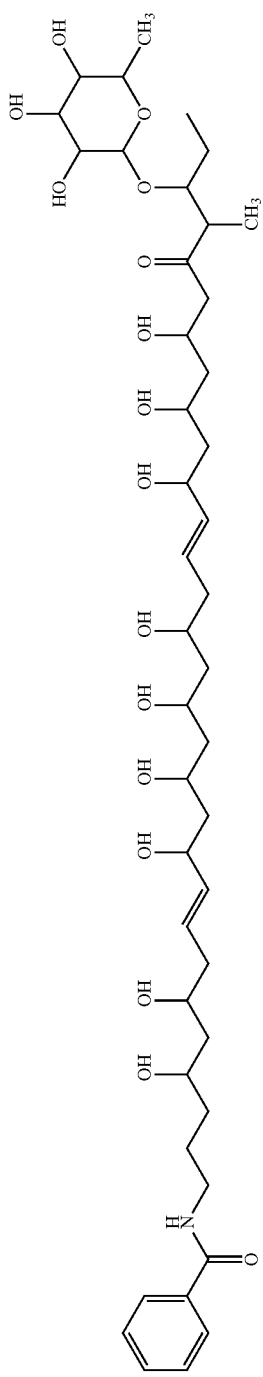
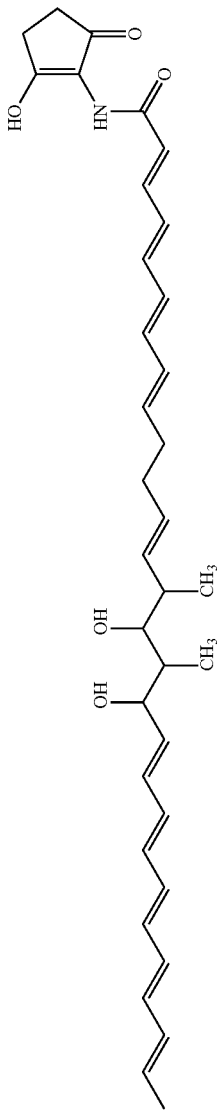
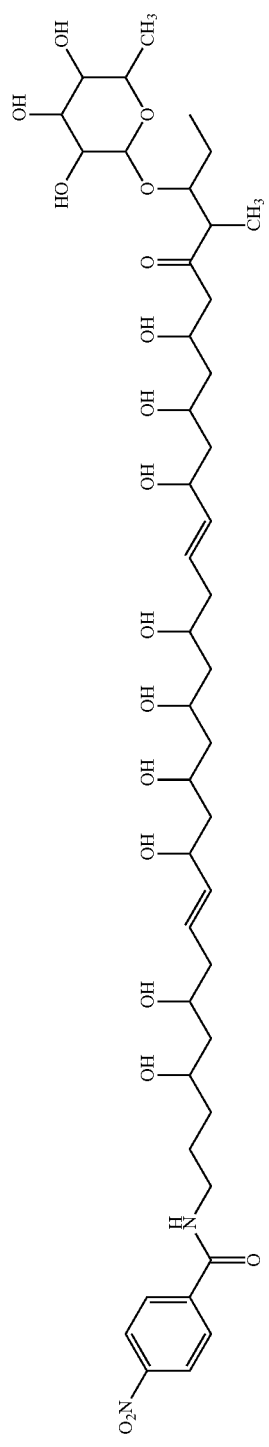
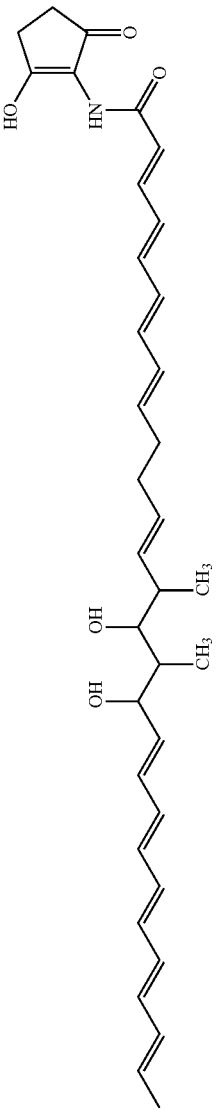

-continued
Compound 2(w)
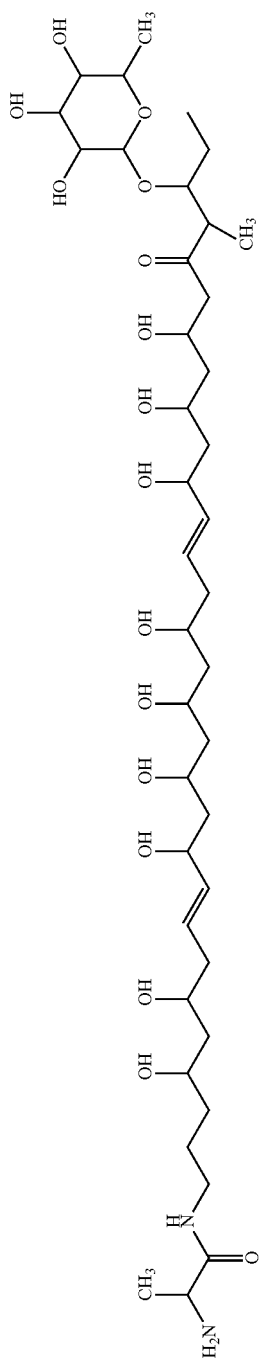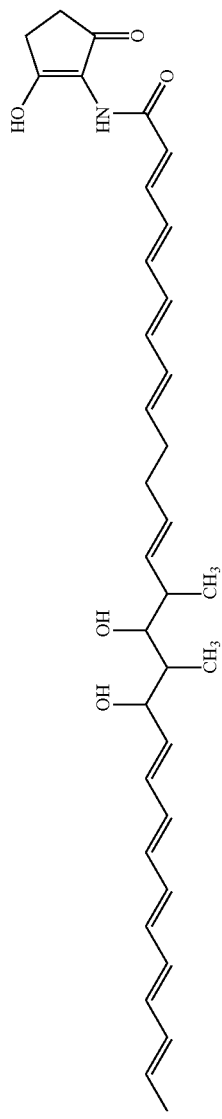
Compound 2(x)
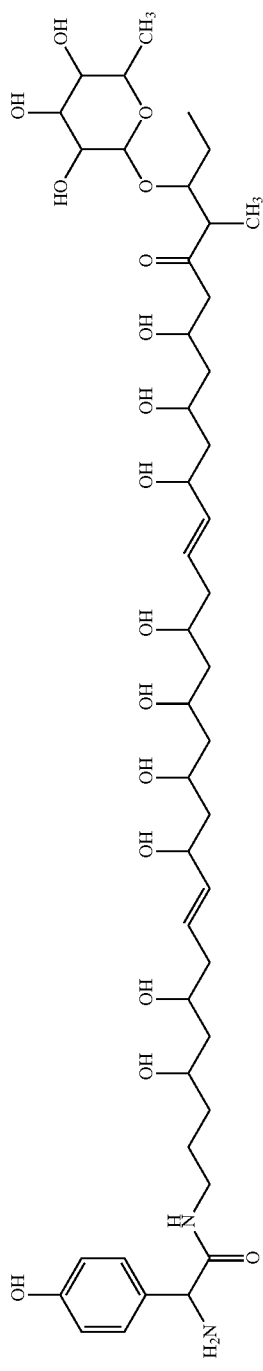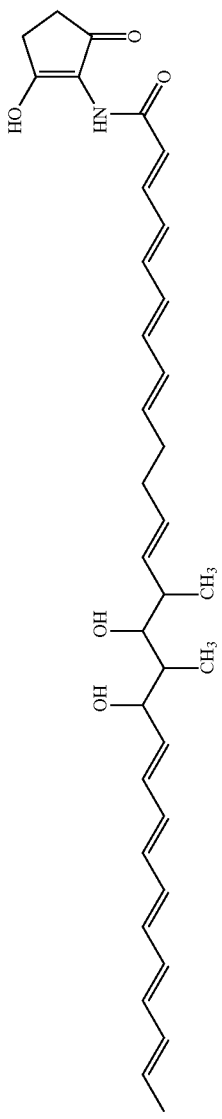

-continued
Compound 2(y)
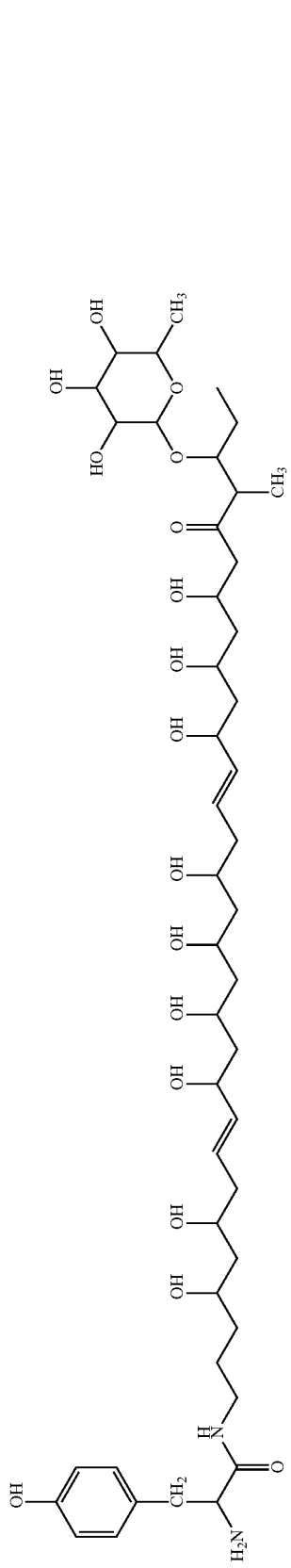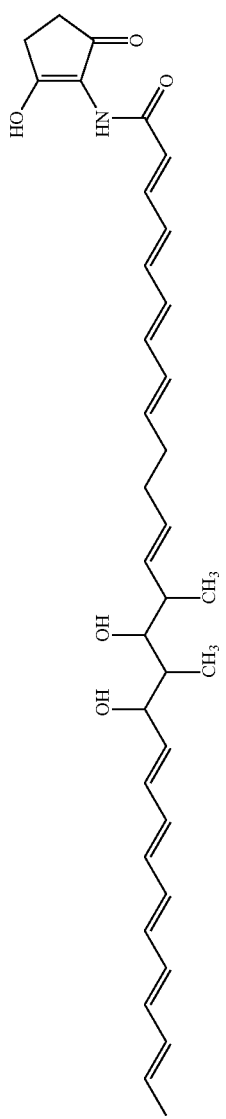
Compound 2(z)
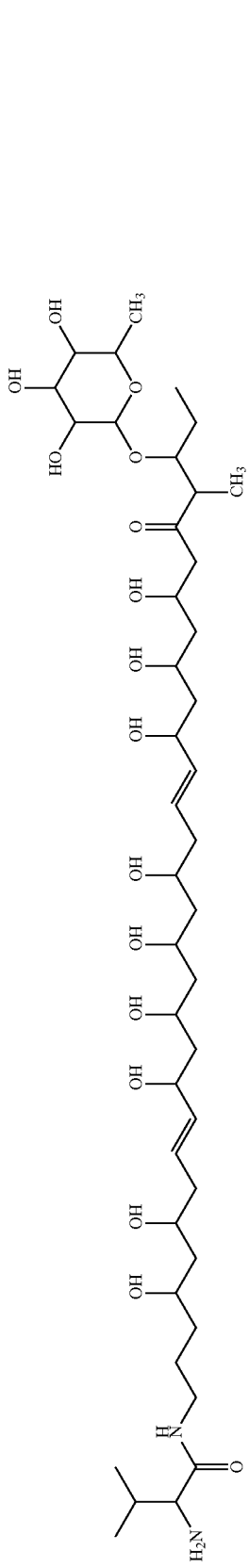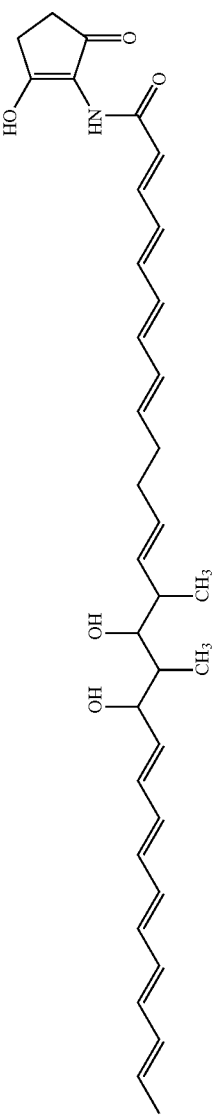

-continued
Compound 2(aa)
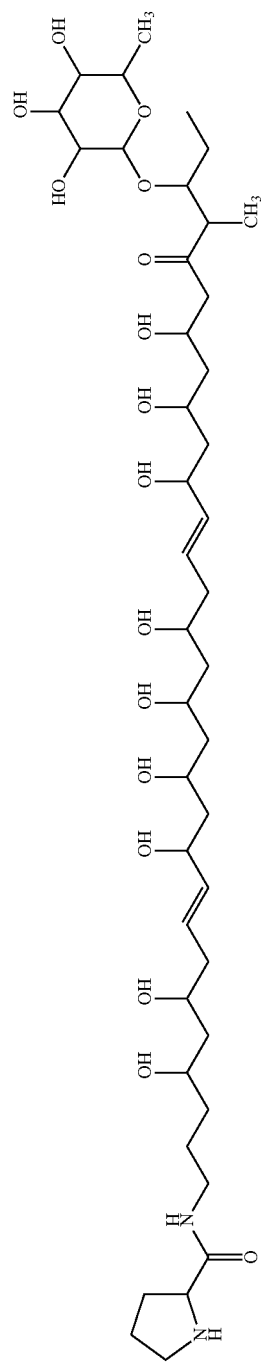
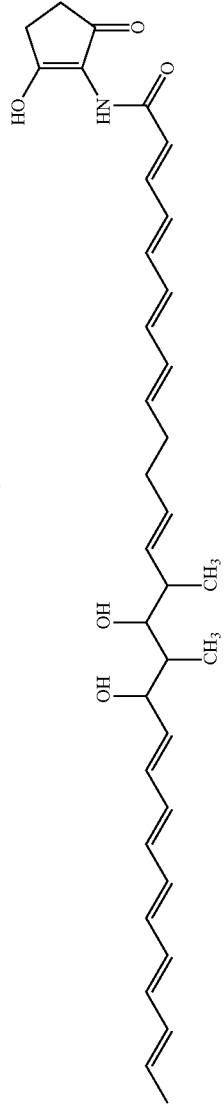
and
Compound 2(ab)
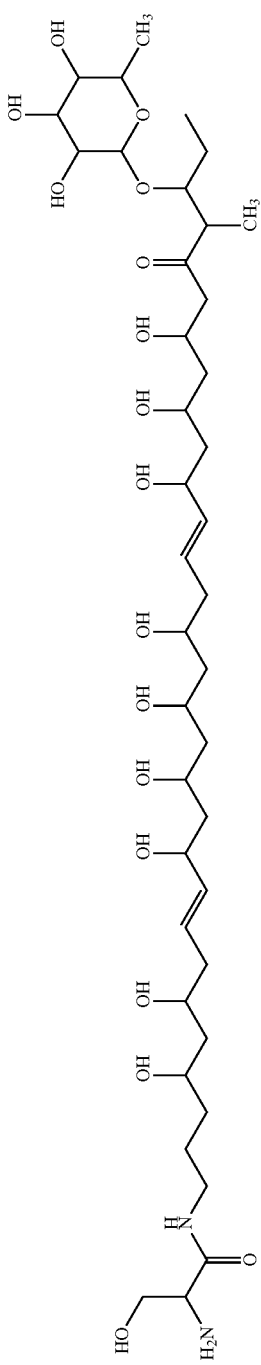
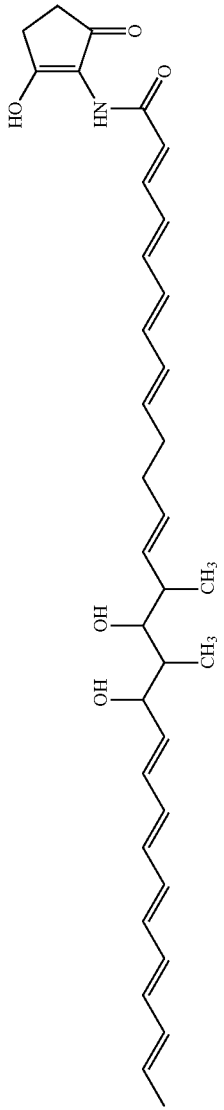

4. A method for obtaining the compound of claim 1, comprising:
(a) culturing cells derived from a *Streptomyces aizunensis* strain aerobically and in a growth medium, whereby the compound of claim 1 is produced,
(b) extracting said medium of (a) with a solvent, and
(c) purifying the compound of claim 1 from the extract of (b), thereby obtaining the compound of claim 1.

5. The method of claim 4 wherein said *Streptomyces aizunensis* strain is NRRL B-11277 or a mutant thereof.

6. The method of claim 5 wherein said mutant is strain [C03]023 (deposit accession number IDAC 070803-1) or [C03U03]023 (deposit accession number IDAC 231203-02).

7. A pharmaceutical composition comprising a therapeutically effective amount of a compound of claim 3 to treat a fungal infection, and a pharmaceutically acceptable carrier.

8. A pharmaceutical composition comprising a therapeutically effective amount of a compound of claim 1 to treat a fungal infection, and a pharmaceutically acceptable carrier.

9. A pharmaceutical composition comprising a therapeutically effective amount of a compound of claim 2 to treat a fungal infection, and a pharmaceutically acceptable carrier.

10. A method of treating a fungal infection in a mammal, comprising administering to a mammal having a fungal infection a therapeutically effective amount of a compound of claim 1.

11. The method of claim 10 wherein said fungal infection is caused by *Candida albicans*.

12. The method of claim 10 wherein said fungal infection is caused by a *Candida* sp., wherein said *Candida* sp. is selected from the group consisting of *C. glabrata, C. lusitaniae C. parapsilosis, C. krusei* and *C. tropicalis*.

13. The method of claim 10 wherein said fungal infection is caused by an *Aspergillus* sp., wherein said *Aspergillus* sp. is selected from the group consisting of *A. fumigatus, A. niger, A. terreus* and *A. flavus*.

14. The method of claim 10 wherein said fungal infection is caused by a fungus selected from the group consisting of *Fusarium* spp.; *Scedosporium* spp.; *Cryptococcus* spp.; *Mucor* ssp.; *Histoplasma* spp.; *Trichosporon* spp.; *Blaspomyces* spp.; and *S. cerevisiae*.

15. A method of treating a fungal infection in a mammal, comprising administering to a mammal having a fungal infection a therapeutically effective amount of a compound of claim 2.

16. The method of claim 15 wherein said fungal infection is caused by *Candida albicans*.

17. The method of claim 15 wherein said fungal infection is caused by a *Candida* sp., wherein said *Candida* sp. is selected from the group consisting of *C. glabrata, C. lusitaniae, C. parapsilosis, C. krusei* and *C. tropicalis*.

18. The method of claim 15 wherein said fungal infection is caused by an *Aspergillus* sp., wherein said *Aspergillus* sp. is selected from the group consisting of *A. fumigatus, A. niger, A. terreus* and *A. flavus*.

19. The method of claim 15 wherein said fungal infection is caused by a fungus selected from the group consisting of *Fusarium* spp.; *Scedosporium* spp.; *Cryptococcus* spp.; *Mucor* ssp.; *Histoplasma* spp.; *Trichosporon* spp.; *Blaspomyces* spp.; and *S. cerevisiae*.

20. A method of treating a fungal infection in a mammal, comprising administering to a mammal having a fungal infection a therapeutically effective amount of a compound of claim 3.

21. The method of claim 20 wherein said fungal infection is caused by *Candida albicans*.

22. The method of claim 20 wherein said fungal infection is caused by a *Candida* sp., wherein said *Candida* sp. is selected from the group consisting of *C. glabrata, C. lusitaniae C. parapsilosis, C. krusei* and *C. tropicalis*.

23. The method of claim 20 wherein said fungal infection is caused by an *Aspergillus* sp., wherein said *Aspergillus* sp. is selected from the group consisting of *A. fumigatus, A. niger, A. terreus* and *A. flavus*.

24. The method of claim 20 wherein said fungal infection is caused by a fungus selected from the group consisting of *Fusarium* spp.; *Scedosporium* spp.; *Cryptococcus* spp.; *Mucor* ssp.; *Histoplasma* spp.; *Trichosporon* spp.; *Blaspomyces* spp.; and *S. cerevisiae*.

* * * * *